(12) United States Patent
Van Ooijen et al.

(10) Patent No.: US 11,610,644 B2
(45) Date of Patent: Mar. 21, 2023

(54) SUPERIOR BIOINFORMATICS PROCESS FOR IDENTIFYING AT RISK SUBJECT POPULATIONS

(71) Applicant: KONINKLIJKE PHILIPS N.V., Eindhoven (NL)

(72) Inventors: Hendrik Jan Van Ooijen, Eindhoven (NL); Anne Godefrida Catharina Van Brussel, Eindhoven (NL); Jenneke Wrobel, Eindhoven (NL); Dianne Arnoldina Margaretha Wilhelmina Van Strijp, Eindhoven (NL); Robert Van Gog, Eindhoven (NL)

(73) Assignee: KONINKLIJKE PHILIPS N.V., Eindhoven (NL)

( * ) Notice: Subject to any disclaimer, the term of this patent is extended or adjusted under 35 U.S.C. 154(b) by 965 days.

(21) Appl. No.: 14/922,419

(22) Filed: Oct. 26, 2015

(65) Prior Publication Data
US 2016/0117439 A1 Apr. 28, 2016

(30) Foreign Application Priority Data
Oct. 24, 2014 (EP) .................................... 14190275

(51) Int. Cl.
*G16B 5/00* (2019.01)
*G16B 25/10* (2019.01)
(Continued)

(52) U.S. Cl.
CPC ............. *G16B 5/20* (2019.02); *C12Q 1/6809* (2013.01); *C12Q 1/6886* (2013.01); *G16B 5/00* (2019.02);
(Continued)

(58) Field of Classification Search
None
See application file for complete search history.

(56) References Cited

U.S. PATENT DOCUMENTS

| 5,436,134 A | 7/1995 | Haugland |
| 5,476,928 A | 12/1995 | Ward |

(Continued)

FOREIGN PATENT DOCUMENTS

| WO | 2012154567 A2 | 11/2012 |
| WO | 2013003384 A1 | 1/2013 |

(Continued)

OTHER PUBLICATIONS

Teschendorff et al. Improved prognostic classification of breast cancer defined by antagnoistic activation patterns of immune response pathway modules. BMC Cancer, 10:604, pp. 1-20 (Year: 2010).*

(Continued)

*Primary Examiner* — Olivia M. Wise

(57) ABSTRACT

A bioinformatics method for determining a risk score that indicates a risk that a subject, in particular a human, will experience a negative clinical event within a certain period of time. The risk score is based on a unique combination of activities of two or more cellular signaling pathways in a subject, wherein the selected cellular signaling pathways are the TGF-β pathway and one or more of a PI3K pathway, a Wnt pathway, an ER pathway, and an HH pathway. The invention includes an apparatus with a digital processor configured to perform such a method, a non-transitory storage medium storing instructions that are executable by a digital processing device to perform such a method, and a computer program comprising program code means for causing a digital processing device to perform such a method. The bioinformatics invention allows for more accurate prognosis of specific negative clinical events in a patient with, for example, a tumor or cancer, such as disease progression, recurrence, development of metastasis, or even death.

8 Claims, 44 Drawing Sheets
Specification includes a Sequence Listing.

(51) Int. Cl.
G16H 50/20 (2018.01)
G16H 50/30 (2018.01)
G16B 5/20 (2019.01)
C12Q 1/6809 (2018.01)
G16B 20/00 (2019.01)
G16B 20/20 (2019.01)
G16B 20/30 (2019.01)
C12Q 1/6886 (2018.01)

(52) U.S. Cl.
CPC .............. *G16B 20/00* (2019.02); *G16B 20/20* (2019.02); *G16B 20/30* (2019.02); *G16B 25/10* (2019.02); *G16H 50/20* (2018.01); *G16H 50/30* (2018.01); *C12Q 2600/158* (2013.01); *C12Q 2600/16* (2013.01)

(56) References Cited

U.S. PATENT DOCUMENTS

| | | | |
|---|---|---|---|
| 5,658,751 | A | 8/1997 | Yue |
| 5,874,219 | A | 2/1999 | Rava |
| 5,958,691 | A | 9/1999 | Pieken |
| 6,004,761 | A | 12/1999 | Linsley |
| 6,146,897 | A | 11/2000 | Cohenford |
| 6,171,798 | B1 | 1/2001 | Levine |
| 6,225,047 | B1 | 5/2001 | Hutchens |
| 6,308,170 | B1 | 10/2001 | Balaban |
| 6,391,550 | B1 | 5/2002 | Lockhart |
| 6,675,104 | B2 | 1/2004 | Paulse |
| 6,720,149 | B1 | 4/2004 | Rava |
| 6,844,165 | B2 | 1/2005 | Hutchens |
| 6,884,578 | B2 | 4/2005 | Warrington |
| 7,056,674 | B2 | 6/2006 | Baker |
| 7,081,340 | B2 | 7/2006 | Baker |
| 7,160,734 | B2 | 1/2007 | Hutchens |
| 7,208,470 | B2 | 4/2007 | Duan |
| 7,299,134 | B2 | 11/2007 | Rich |
| 7,526,637 | B2 | 4/2009 | Jung |
| 7,569,345 | B2 | 8/2009 | Cobleigh |
| 7,695,913 | B2 | 4/2010 | Cowens |
| 7,723,033 | B2 | 5/2010 | Baker |
| 7,754,431 | B2 | 7/2010 | Ring |
| 7,754,861 | B2 | 7/2010 | Boschetti |
| 7,816,084 | B2 | 10/2010 | Ring |
| 7,838,224 | B2 | 11/2010 | Baker |
| 7,858,304 | B2 | 12/2010 | Baker |
| 7,888,019 | B2 | 2/2011 | Kiefer |
| 7,930,104 | B2 | 4/2011 | Baker |
| 7,939,261 | B2 | 5/2011 | Baker |
| 8,008,003 | B2 | 8/2011 | Baker |
| 8,021,894 | B2 | 9/2011 | Hutchens |
| 8,026,060 | B2 | 9/2011 | Watson |
| 8,029,995 | B2 | 10/2011 | Watson |
| 8,029,997 | B2 | 10/2011 | Kennedy |
| 8,034,565 | B2 | 10/2011 | Cobleigh |
| 8,067,178 | B2 | 11/2011 | Baker |
| 8,071,286 | B2 | 12/2011 | Baker |
| 8,148,076 | B2 | 4/2012 | Baker |
| 8,153,378 | B2 | 4/2012 | Cowens |
| 8,153,379 | B2 | 4/2012 | Watson |
| 8,153,380 | B2 | 4/2012 | Watson |
| 8,198,024 | B2 | 6/2012 | Watson |
| 8,206,919 | B2 | 6/2012 | Cobleigh |
| 8,273,537 | B2 | 9/2012 | Watson |
| 8,367,345 | B2 | 2/2013 | Cowens |
| 8,451,450 | B2 | 5/2013 | Heng |
| 8,518,639 | B2 | 8/2013 | Rihet |
| 8,632,980 | B2 | 1/2014 | Baker |
| 8,703,736 | B2 | 4/2014 | Whatcott |
| 8,725,426 | B2 | 5/2014 | Shak |
| 8,741,605 | B2 | 6/2014 | Cobleigh |
| 8,765,383 | B2 | 7/2014 | Cowens |
| 8,808,994 | B2 | 8/2014 | Kiefer |
| 8,868,352 | B2 | 10/2014 | Baker |
| 8,906,625 | B2 | 12/2014 | Kiefer |
| 8,911,940 | B2 | 12/2014 | Weiss |
| 9,076,104 | B2 | 7/2015 | Wang |
| 2004/0180341 | A1 | 9/2004 | Sedivy |
| 2006/0234911 | A1 | 10/2006 | Hoffmann |
| 2009/0105962 | A1 | 4/2009 | Woolf |
| 2009/0186024 | A1 | 7/2009 | Nevins |
| 2010/0131432 | A1 | 5/2010 | Kennedy |
| 2010/0273711 | A1 | 10/2010 | Potti |
| 2010/0285980 | A1 | 11/2010 | Shak |
| 2011/0053804 | A1 | 3/2011 | Massague |
| 2011/0091377 | A1 | 4/2011 | Alani |
| 2011/0129833 | A1 | 6/2011 | Baker |
| 2012/0009581 | A1 | 1/2012 | Bankaitis-Davis |

FOREIGN PATENT DOCUMENTS

| | | | |
|---|---|---|---|
| WO | 2013011479 | A2 | 1/2013 |
| WO | 2013075059 | A1 | 5/2013 |
| WO | 2014102668 | A2 | 7/2014 |
| WO | 2014174003 | A1 | 10/2014 |
| WO | 2015101635 | A1 | 7/2015 |

OTHER PUBLICATIONS

Malinowsky et al. Activation of the PI3K/AKT pathway correlates with prognosis in stage II colon cancer. British Journal of Cancer Mar. 11, 2014, 110, pp. 2081-2089 (Year: 2014).*

Katz et al. Targeting TGF-beta signaling in cancer. Expert Opin Ther Targets, 17(7), pp. 743-760 (Year: 2013).*

Van de Stolpe et al. RNA Based Approaches to Profile Oncogenic Pathways From Low Quantity Samples to Drive Precision Oncology Strategies. Frontiers in Genetics, Feb. 2021, 11:598118, pp. 1-16 (Year: 2021).*

Weigelt et al. Genomic determinants of PI3K pathway inhibitor response in cancer. Frontiers in Oncology, Aug. 2012, vol. 2, Article 109, pp. 1-16 (Year: 2012).*

Chen et al. Constitutively Nuclear FOXO3a Localization Predicts Poor Survival and Promotes Akt Phosphorylation in Breast Cancer. PLoS One, Aug. 2010, vol. 5, Issue 8, e12293, pp. 1-17 (Year: 2010).*

De Kruijf et al. The prognostic role of TGF-beta signaling pathway in breast cancer patients. Annals of Oncology, 2013, 24, pp. 384-390 (Year: 2013).*

Zu et al. Transforming growth factor-beta signaling in tumor initiation, progression and therapy in breast cancer: an update. Cell Tissue Research, 2012, 347:73-84 (Year: 2012).*

Zhang, Ping et al "Joint loading-driven bone formation and signaling pathways genome-wide expression profiles", Bone, vol. 44, 2009, pp. 989-998.

Guo, Xing et al "Signaling cross-talk between TGF-p/BIVIP and other pathways", Cell Research, 2009, vol. 19, pp. 71-88.

Mishra, Lopa et al "The role of TG¥-ß and Wnt signaling in gastrointestinal stem cells and cancer", Oncogene, 2005, vol. 24, pp. 5775-5789.

Shen, Haige "Bayesian Analysis in Cancer Pathway Studies and Probabilistic Pathway Annotation", Duke University 2008.

Chen, Min et al "A Powerful Bayesian Meta-Analysis Method to Integrate Multiple Gene Set Enrichment Studies", Bioinformatic, vol. 29, No. 7, 2013, pp. 862-869.

Fanelli, Laise P. et al "Modeling TGF-Beta Signaling Pathway in Epithelial-Mesenchymal Transistion", AIP Advances, 2012, vol. 2, No. 1. Abstract Only.

Sharkey, David J. et al "TGF-b Mediates Proinflammatory Seminal Fluid Signaling in Human Cervical Epithelial Cells", The Journal of Immunology, vol. 189, 2012, pp. 1024-1035.

Derynck, Rik et al Smad-Dependent and Smad-Independent Pathways in TGF-Beta Family Signalling:, Nature, vol. 425, 2003, pp. 577-584.

Wahdan-Alaswad, Reema S. et al "Inhibition of mTORCI Kinase Activates Smads 1 and 5 but Not SmadS in Human Prostate Cancer Cells, Mediating Cytostatic Response to Rapamycin", Molecular Cancer Research, Signaling and Regulation, 2012, pp. 821-834.

(56) References Cited

OTHER PUBLICATIONS

Nacif, Michael et al "Targeting Transforming Growth Factor Beta(Tgf-Beta) in Cancer and Non-Neoplastic Diseases", Journal of Cancer Therapy, vol. 5, 2014, pp. 735-747.
Padua, David et al "Roles of TGFβ in Metastasis", Cell Research vol. 19, 2009, pp. 89-102.
Verhaegh, Wim et al "Selection of Personalized Patient Therapy through the Use of Knowledge-Based Computational Models That Identify Tumor-Driving Signal Transduction Pathways", Cancer Research, vol. 74, No. 11, 2014, pp. 2936-2945.
Sheen, Yhun Y. et al "Targeting the Transforming Growth Factor-b Signaling in Cancer Therapy", Biomolecules & Therapeutics, vol. 21, No. 5, 2013, pp. 323-331.
Verhaegh, Wim et al "Knowledge-based Computational Models", Oncotarget, vol. 5, No. 14, 2014.
Verhaegh, Wim et al, "Selection of Personalized Patient Therapy through the use of Knowledge-Based Computational Models that Identify Tumor-Driving Signal Transduction Pathways", Cancer Research, Integrated Systems and Technologies: Mathematical Oncology, vol. 74, No. 11, Jun. 2014.
"Measuring Functional Activity of Signal Transduction Pathways from target Gene mRNA Levels", Philips Molecular Pathway DX, Oct. 2020.
Van De Stolpe, Anja et al "Enabling Precision Medicine by Unravelling Disease Pathophysiology: Quantifying Signal Transduction Pathway Activity Across Cell and Tissue Types", Scientific Reports Feb. 2019.
Van Ooijen, Henk et al "Prognosis within Different Breast Cancer Subtypes using Functional Activity of Signaling Pathways", Philips Research, 2015.

\* cited by examiner

SUPERIOR BIOINFORMATICS PROCESS FOR IDENTIFYING AT RISK SUBJECT POPULATIONS

RELATED APPLICATIONS

This application claims the benefit of European Patent Application No. EP14190275.9, filed Oct. 24, 2014, the entirety of the specification and claims thereof is hereby incorporated by reference for all purposes.

INCORPORATION-BY-REFERENCE OF MATERIAL SUBMITTED ON AS A TEXT FILE VIA THE OFFICE ELECTRONIC FILING SYSTEM (EFS-WEB)

A Sequence Listing associated with this application is provided in text format in lieu of a paper copy, and is hereby incorporated by reference into the specification. The name of the text file containing the Sequence Listing is 2014PF01382_2015-10-26_sequencelisting_ST25.txt. The text file is 901 KB, was created on Oct. 26, 2015, and is being submitted electronically via EFS-Web.

FIELD

The present disclosure is in the field of systems biology, bioinformatics, genomic mathematical processing, and proteomic mathematical processing. In particular, the present disclosure is a method for identifying a subject, typically a human, at risk of experiencing a negative clinical event associated with a disease or disorder, for example, a tumor or cancer, within a certain period of time based on the evaluation of its TGF-β pathway and one or more of a PI3K pathway, a Wnt pathway, an ER pathway, and an HUI pathway. The disclosure also includes an apparatus with a digital processor configured to perform such a method, a non-transitory storage medium storing instructions that are executable by a digital processing device to perform such a method, and a computer program that includes a program code means for causing a digital processing device to perform such a method. The present disclosure also includes kits for measuring expression levels for the unique combinations of target genes.

BACKGROUND

As knowledge of tumors including cancers evolve, it becomes more clear that they are extraordinarily heterogeneous and multifactorial. Tumors and cancers have a wide range of genotypes and phenotypes, they are influenced by their individualized cell receptors (or lack thereof), microenvironment, extracellular matrix, tumor vascularization, neighboring immune cells, and accumulations of mutations, with differing capacities for proliferation, migration, stem cell properties and invasion. This scope of heterogeneity exists even among same classes of tumors. See generally: Nature insight: Tumor Heterogeneity (entire issue of articles), 19 Sep. 2013 (Vol. 501, issue 7467); Zellmer and Zhang, "Evolving concepts of tumor heterogeneity", Cell and Bioscience 2014, 4:69.

Traditionally, physicians have treated tumors, including cancers, as the same within class type (including within receptor type) without taking into account the enormous fundamental individualized nature of the diseased tissue. Patients have been treated with available chemotherapeutic agents based on class and receptor type, and if they do not respond, they are treated with an alternative therapeutic, if it exists. This is an empirical approach to medicine.

There has been a growing trend toward taking into account the heterogeneity of tumors at a more fundamental level as a means to create individualized therapies, however, this trend is still in its formative stages. What is desperately needed are approaches to obtain more metadata about the tumor to inform therapeutic treatment in a manner that allows the prescription of approaches more closely tailored to the individual tumor, and perhaps more importantly, avoiding therapies destined to fail and waste valuable time, which can be life-determinative.

The Wnt signaling pathway affects cell proliferation, and is highly regulated. High Wnt pathway activity due to loss of regulation has been associated with the development and advancement of certain disease, for example cancer and the development of malignant colon tumors. It is believed that deregulation of the Wnt pathway in malignant colon cells leads to high Wnt pathway activity that in turn causes cell proliferation of the malignant colon cells, i.e., spread of colon cancer. On the other hand, abnormally low pathway activity might also be of interest, for example in the case of osteoporosis. Other pathways which play similar roles in cell division, function and/or differentiation in health and disease are cellular signaling pathways such as ER, PR, AR, PPAR, GR, VitD, TGF-β, Notch, Hedgehog, FGF, NFkB, VEGF, and PDGF.

Technologies for acquiring genomic and proteomic data have become readily available in clinical settings. For example, measurements by microarrays are employed to assess gene expression levels, protein levels, methylation, and so forth. Automated gene sequencing enables cost-effective identification of genetic variations/mutations/abnormal methylation patterns in DNA and mRNA. Quantitative assessment of mRNA levels during gene sequencing holds promise as a clinical tool for assessing gene expression levels.

A number of companies and institutions are active in the area of traditional, and some more advanced, genetic testing, diagnostics, and predictions for the development of human diseases, including, for example: Affymetrix, Inc.; Bio-Rad, Inc; Roche Diagnostics; Genomic Health, Inc.; Regents of the University of California; Illumina; Fluidigm Corporation; Sequenom, Inc.; High Throughput Genomics; NanoString Technologies; Thermo Fisher; Danaher; Becton, Dickinson and Company; bioMerieux; Johnson & Johnson; Myriad Genetics, and Hologic.

Genomic Health, Inc. is the assignee of numerous patents pertaining to gene expression profiling, for example: U.S. Pat. Nos. 7,081,340; 8,808,994; 8,034,565; 8,206,919; 7,858,304; 8,741,605; 8,765,383; 7,838,224;8,071,286; 8,148,076; 8,008,003; 8,725,426; 7,888,019; 8,906,625; 8,703,736; 7,695,913; 7,569,345; 8,067,178; 7,056,674;8,153,379; 8,153,380; 8,153,378; 8,026,060; 8,029,995; 8,198,024; 8,273,537; 8,632,980; 7,723,033; 8,367,345; 8,911,940; 7,939,261; 7,526,637; 8,868,352; 7,930,104; 7,816,084; 7,754,431 and 7,208,470, and their foreign counterparts.

U.S. Pat. No. 9,076,104 to the Regents of the University of California titled "Systems and Methods for identifying Drug Targets using Biological Networks" claims a method with computer executable instructions by a processor for predicting gene expression profile changes on inhibition of proteins or genes of drug targets on treating a disease, that includes constructing a genetic network using a dynamic Bayesian network based at least in part on knowledge of drug inhibiting effects on a disease, associating a set of parameters with the constructed dynamic Bayesian network, determining the values of a joint probability distribution via an automatic procedure, deriving a mean dynamic Bayesian network with averaged parameters and calculating a quantitative prediction based at least in part on the mean dynamic Bayesian network, wherein the method searches for an optimal combination of drug targets whose perturbed gene expression profiles are most similar to healthy cells.

Affymetrix has developed a number of products related to gene expression profiling. Non-limiting examples of U.S. Patents to Affymetrix include: U.S. Pat. Nos. 6,884,578; 8,029,997; 6,308,170; 6,720,149; 5,874,219; 6,171,798; and 6,391,550.

Likewise, Bio-Rad has a number of products directed to gene expression profiling. Illustrative examples of U.S. Patents to Bio-Rad include: U.S. Pat. Nos. 8,021,894; 8,451,450; 8,518,639; 6,004,761; 6,146,897; 7,299,134; 7,160,734; 6,675,104; 6,844,165; 6,225,047; 7,754,861 and 6,004,761.

Koninklijke Philips N. V. (NL) has filed a number of patent applications in the general area of assessment of cellular signaling pathway activity using various mathematical models, including U.S.S.N. 14/233,546 (WO 2013/011479), titled "Assessment of Cellular Signaling Pathway Using Probabilistic Modeling of Target Gene Expression"; U.S.S.N. 14/652,805 (WO 2014/102668) titled "Assessment of Cellular Signaling Pathway Activity Using Linear Combinations of Target Gene Expressions; WO 2014/174003 titled "Medical Prognosis and Prediction of Treatment Response Using Multiple Cellular Signaling Pathway Activities; and WO 2015/101635 titled "Assessment of the PI3K Cellular Signaling Pathway Activity Using Mathematical Modeling of Target Gene Expression".

Physicians must use caution in administering a drug that modulates a target pathway to a patient with a tumor, including cancer, because that pathway may either be not tumor-affecting and/or may be playing a tumor suppressing role. Further, the role of the pathway can change over time. It is therefore important to be able to more accurately assess the functional state of the target pathway at specific points in disease progression.

It is therefore an object of the disclosure to provide a more accurate process to determine the individual characteristics of a tumor, tumorigenic propensity of the cellular signaling pathways in a cell, as well as associated methods of therapeutic treatment, kits, systems, etc.

SUMMARY

The present disclosure includes methods and apparatuses capable of identifying a subject, in particular a human, at risk of experiencing a negative clinical event associated with a disease such as a tumor or cancer within a defined period of time by determining the activity level of a transforming growth factor-β (TGF-β) cellular signaling pathway in combination with at least one other cellular signaling pathway selected from a phosphatidylinositide 3-kinase (PI3K) signaling pathway, a Wnt signaling pathway, an estrogen-receptor (ER) signaling pathway, or a hedgehog (HH) signaling pathway, using the methods described herein. It has been discovered that analyzing the activity levels of these specific cellular signaling pathways using the methods described herein provides for an advantageously accurate prediction that a subject, such as a human, will experience a negative clinical event associated with a particular disorder. The clinical event can be for example, but not limited to, death, disease recurrence, disease progression, development of metastasis, survival, development of cancer, for example, of a tumor or cancer, which in nonlimiting embodiments may be breast, prostate, lung, glioma or colon cancer.

It has been established, as further described herein, that functional cellular pathway activities can be significantly different between, and within, particular diseases and disorders. The use of combinatorial cellular signaling pathway activity analysis using multi-pathway score (MPS) modeling as described herein can be used to directly define the specific risks of experiencing negative clinical events associated with the disease. This accurate risk assessment allows, for example, a clinician to develop or adjust a treatment modality to reduce or avoid the risk of experiencing the clinical event. The use of the specific pathways and methods described herein can be a powerful tool in guiding clinical modalities based on the prognosis and subtyping identification in, for example, a tumor or cancer in a human, which in turn dictates the risk of experiencing a negative clinical event within a period of time associated with the particular disease. By identifying these subject populations before the occurrence of the clinical event, a greater understanding of treatment options and efficacies is provided. Thus, the current disclosure provides detailed information on, not only the risk of experiencing a clinical event, but why the subject is likely to experience the clinical event, allowing the clinician to better address the underlying causative abnormal pathway.

The cellular signaling pathways targeted herein are known to control a number of functions in a range of cell types in humans, such as proliferation, differentiation, energy metabolism, and wound healing. For example, in pathological disorders, such as cancer (e.g., colon, pancreatic, lung, brain or breast cancer), the TGF-β cellular signaling pathway can play two opposing roles, either as a tumor suppressor or as a tumor promoter. In early phases of cancer development, TGF-β may act as a tumor suppressor, however in more progressed cancerous tissue TGF-β can act as a tumor promoter by acting as a regulator of invasion and metastasis (see Padua D. and Massagué J., "Roles of TGF-β in metastasis", Cell Research, Vol. 19, No, 1, 2009, pages 89 to 102). These differing states are detectable in the expression profiles of the identified unique TGF-β target genes and thus exploited by means of the current disclosure using the described mathematical model. Furthermore, a number of anti-TGF-β therapies are in preclinical or clinical development (see Yingling J. M. et al., "Development of TGF-3 signaling inhibitors for cancer therapy", Nature Reviews Drug Discovery, Vol. 3, No. 12, 2004, pages 1011 to 1022; Nacif and Shaker, "Targeting Transforming Growth Factor-B (TGF-β) in Cancer and Non-Neoplastic Diseases"; Journal of Cancer Therapy, 2014, 5, 735-747). However, because of the pleiotropic effects of TGF-β, long term dosing strategies with TGF-β inhibitors may be ill-advised and development of drug resistance might potentiate tumor progression.

Conversely, increased ER cellular signaling pathway activity corresponds with a better prognosis in certain cancer, for example breast cancers, than the lack of ER cellular signaling activity. PI3K cellular signaling, for example, has been associated with a poorer prognosis and clinical outcome in subjects with, for example, breast cancer. Importantly, the functional pathway activities of the selected cellular signaling pathways can differ even within disease subgroups, resulting in disparate responses to standardized treatments. By utilizing the present disclosure, subjects at risk for experiencing disparate or non-efficacious responses to a standard treatment can be identified prior to the start of treatment, or during progression of the disease or the treatment, may have their treatments adjusted accordingly, thereby addressing the risk associated with a particular combination of cellular signaling pathway activities.

The present disclosure identifies subjects at risk for developing a negative clinical event associated with a disease in two steps:
  a.) First determining an activity level of a TGF-β cellular signaling pathway in a sample isolated from the subject, wherein the TGF-β cellular signaling pathway activity is calculated by i) calculating an activity level of a TGF-β transcription factor element in the sample, wherein the activity level of the TGF-β transcription factor element in the sample is calculated by (1) receiving data on the expression levels of at least three TGF-β target genes derived from the sample, wherein the TGF-β transcription factor element controls transcription of the at least three TGF-β target genes, (2) calculating the activity levels of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and, ii) calculating the activity level of the TGF-β cellular signaling pathway in the sample based on the calculated activity level of the TGF-β transcription factor element in the sample.
  b.) Second, the determination of the TGF-β cellular signaling pathway activity is then analyzed in combination or in light of the activity level of at least one additional cellular signaling pathway selected from a PI3K signaling pathway, a Wnt signaling pathway, an ER signaling pathway, or a HH signaling pathway by calculating an activity level of at least one additional cellular signaling pathway in the sample, wherein the activity level of the additional cellular signaling pathways is calculated by i) calculating an activity level of a transcription factor element from the additional cellular signaling pathway in the sample, wherein the activity level of the transcription factor element of the additional cellular signaling pathway is calculated by (1) receiving data on the expression levels of at least three target genes of the additional cellular signaling pathway derived from the sample, wherein the transcription factor element of the additional cellular signaling pathway controls transcription of the at least three target genes of the additional cellular signaling pathway, and (2) calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and ii) calculating the activity level of the additional cellular signaling pathway in the sample based on the calculated activity level of the transcription factor element of the additional cellular signaling pathway in the sample.

The term "transcription factor element" as used herein refers to an intermediate or precursor protein or protein complex of the active transcription factor, or an active transcription factor protein or protein complex which controls the specified target gene expression. As an illustrative example as to how this term is used, the term "TGF-β transcription factor element" or "TGF-β TF element" or "TF element" refers to a signaling agent downstream of the binding of TGF-β to its receptor which controls target gene expression, which may be a transcription factor protein or protein complex or a precursor of an active transcription protein complex. It can be, in embodiments, a signaling agent triggered by the binding of TGF-β to its receptor downstream of TGF-β extracellular receptor binding and upstream of the formation of the active transcription factor protein complex. For example, it is known that when TGF-β binds to an extracellular TGF-β receptor, it initiates an intracellular "SMAD" signaling pathway and that one or more SMAD proteins (for example receptor-regulated or R-SMADs (SMAD 1, 2, 3, 5 and 8) and SMAD4) participate in, and may form a heterocomplex which participates in, the TGF-β transcription signaling cascade which controls expression. Transcription factor elements for the other signaling pathways. PI3K, Wnt, ER, and HH are defined analogously based on their specific signaling cascade members that control expression.

The activity levels of the TGF-β cellular signaling pathway and the at least one other cellular signaling pathway are then used to calculate a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of a negative clinical event. The resultant MPS score can be used to assign a risk of experiencing the clinical event. Using an MPS model across the cellular signaling pathways identified herein provides important and significant biological insight into the risk of certain clinical events occurring.

In one particular aspect of the present disclosure, expression levels from unique sets of target genes from the analyzed cellular signaling pathways are used to determine the activity level of the cellular signaling pathways. It has been discovered that analyzing a specific set of target genes as described herein in the disclosed pathway model provides for an advantageously accurate cellular signaling pathway activity determination, which, in turn, provides further accuracies in determining the occurrence of a particular clinical event occurring.

The determination of the activity level of the described combinations of the cellular signaling pathways based on expression levels of unique sets of genes, and applying the calculated activity levels to a MPS model which has been calibrated against specific clinical event occurrences provides a powerful tool for identifying subjects at risk of experiencing particular clinical events, for example but not limited to, the presence or risk of developing a disease within a period of time, the recurrence of diseases, the advancement of disease, the development of metastasis of a disease, or even death or survival. Importantly, the present disclosure allows the identification of subjects such as humans at risk for such clinical events within a specific time period, for example, 3 months, 6 months, 1 year, 18 months, 2 years, 30 months, 3 years, 42 months, 4 years, 5 years, 6 years, 7 years, 8 years, 9 years, or 10 years or more. This information can be used, for example, to adjust therapeutic protocols to, for example, adjust treatment to administer a cellular signaling pathway inhibitor, wherein the identified cellular signaling pathway's activity level or status is associated with the identified clinical risk occurring.

The present disclosure is based on the innovation of the inventors that a suitable way of identifying effects occurring in the specified cellular signaling pathway can be based on a measurement of the signaling output of the particular cellular signaling pathway, which is —among others— the transcription of the unique target genes described herein by the specific transcription factor (TF) elements controlled by the cellular signaling pathways. This innovation by the inventors assumes that the TF level is at a quasi-steady state in the sample which can be detected by means of—among others—the expression values of the uniquely identified target genes.

In particular, unique sets of cellular signaling pathway target genes whose expression levels are analyzed in the model have been identified. For use in the model, at least one, at least two, at least three, at least four, at least, five, at least six, at least seven, at least eight, at least nine, at least ten or more target genes from each assessed cellular signaling pathway can be analyzed to develop a risk score.

For example at least three target genes, at least four target genes, at least five target genes, or at least six target genes, at least seven target genes, at least eight target genes, at least nine target genes, at least ten target genes, or more selected from the TGF-β cellular signaling pathway target genes ANGPTL4, CDC42EP3, CDKN1A, CDKN2B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA can be used. In certain embodiments, at least three TGF-β target genes are selected from ANGPTL4, CDC42EP3, ID1, IL11, JUNB, SERPINE1, SKIL, or SMAD7. In certain embodiments, the expression levels of the TGF-β target genes ANGPTL4, CDC42EP3, ID1, SERPINE1, JUNB, SKIL, or SMAD7, or ANGPTL4, CDC42EP3, ID1, SERPINE1, JUNB, SKIL, SMAD7, CDKN1A, CTGF, GADD45B, VEGFA, and SNAI2 are determined.

As further contemplated herein, the expression levels of at least three or more, for example, three, four, five, six, seven, eight, nine, ten, eleven, twelve or more PI3K target genes are analyzed, wherein the PI3K target genes are selected from ATP8A1, BCL2L11, BNIP3, BTG1, C10orf10, CAT, CBLB, CCND1, CCND2, CDKN1B, DDB1, DYRK2, ERBB3, EREG, ESR1, EXT1, FASLG, FGFR2, GADD45A, IGF1R, IGFBP1, IGFBP3, INSR, LGMN, MXI1, PPM1D, SEMA3C, SEPP1, SESN1, SLC5A3, SMAD4, SOD2, TLE4, and TNFSF10. In some embodiment, the at least three or more PI3K target genes are selected from AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNTSF10. In further embodiments, the expression levels of the PI3K target genes FBXO32, BCL2L11, SOD2, TNFSF10, BCL6, BTG1. CCNG2, CDKN1B, BNIP3, GADD45A, INSR, and MXI1 are determined.

In certain embodiments, at least three, four, five, six, seven, eight, nine, ten, eleven, twelve, or more Wnt target genes are selected from ADRA2C, ASCL2, AXIN2, BMP7, CCND1, CD44, COL18A1, DEFA6, DKK1, EPHB2, EPHB3, FAT1, FZD7, GLUL, HNF1A, CXCL8 (previously known as IL8), CEMIP (previously known as KIAA1199), KLF6, LECT2, LEF1, LGR5, MYC, NKD1, OAT, PPARG, REG1B, RNF43, SLC1A2, SOX9, SP5, TBX3, TCF7L2, TDGF1, and ZNRF3. In certain embodiments, the at least three or more Wnt target genes are selected from CEMIP, AXIN2, CD44, RNF43, MYC, TBX3, TDGF1, SOX9, ASCL2, CXCL8, SP5, ZNRF3, EPHB2, LGR5, EPHB3, KLF6, CCND1, DEFA6, and FZD7. In still further embodiments, the expression levels of the Wnt target genes AXIN2, CD44, LGR5, CEMIP, MYC, CXCL8, SOX9, EPHB3, RNF43, TDGF1 ZNRF3, and DEFA6 are determined.

In certain embodiments, the expression levels of at least three, four, five, six, seven, eight, nine, ten, eleven, twelve, or more ER target genes are analyzed, wherein the ER target genes are selected from AP1B1, ATP5J, COL18A1, COX7A2L, CTSD, DSCAM, EBAG9, ESR1, HSPB1, KRT19, NDUFV3, NRIP1, PGR, PISD, PRDM15, PTMA, RARA, SOD1, TFF1, TRIM25, XBP1, GREB1, IGFBP4, MYC, SGK3, WISP2, ERBB2, CA12, CDH26, and CELSR2. In certain embodiments, at least three or more ER target genes are selected from CDH26, SGK3, PGR, GREB1, CA12, XBP1, CELSR2, WISP2, DSCAM, ERBB2, CTSD, TFF1, PDZK1, IGFBP4, ESR1, SOD1, AP1B1, and NRIP1. In certain embodiments, the expression levels of the ER target genes TFF1, GREB1, PGR, SGK3, PDZK1, IGFBP4, NRIP1, CA12, XBP1, ERBB2, ESR1, and CELSR2 are determined.

The use of unique target genes of the HH pathway is provided, wherein at least three, at least four, at least five, at least six, at least seven, at least eight, at least nine, at least ten, at least eleven, at least twelve or more HH target genes are selected from GLI1, PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, CTSL1, TCEA2, MYLK, FYN, PITRM1, CFLAR, IL1R2, S100A7, S100A9, CCND1, JAG2, FOXM1, FOXF1, and FOXL1. In certain embodiments, the at least three or more HH target genes are selected from GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1. In certain embodiments, the expression levels of the HH target genes GLI1, PTCH1, PTCH2, CCND2, IGFBP6, MYCN, FST, RAB34, GLI3, CFLAR, S100A7, and S100A9 are determined.

In one aspect of the disclosure, provided here is a method for identifying a subject at risk of experiencing a negative clinical event associated with a disease within a defined period of time performed by a computerized device having a processor comprising:

a. calculating an activity level of a transforming growth factor-β (TGF-β) cellular signaling pathway in a sample isolated from the subject, wherein the TGF-β cellular signaling pathway activity is calculated by:
   i. calculating an activity level of a TGF-β transcription factor element in the sample, wherein the activity level of the TGF-β transcription factor element in the sample is calculated by:
      1. receiving data on the expression levels of at least three TGF-β target genes derived from the sample, wherein the TGF-β transcription factor element controls transcription of the at least three TGF-β target genes,
      2. calculating the activity levels of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and, ii. calculating the activity level of the TGF-β cellular signaling pathway in the sample based on the calculated activity level of the TGF-β transcription factor element in the sample; and, b. calculating an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity levels of the additional cellular signaling pathways is calculated by:

i. calculating an activity level of a transcription factor element from the additional cellular signaling pathway in the sample, wherein the activity level of the transcription factor element of the additional cellular signaling pathway is calculated by:

1. receiving data on the expression levels of at least three target genes of the additional cellular signaling pathway derived from the sample, wherein the transcription factor element of the additional cellular signaling pathway controls transcription of the at least three target genes of the additional cellular signaling pathway, 2. calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and, ii. calculating the activity level of the additional cellular signaling pathway in the sample based on the calculated activity level of the transcription factor element of the additional cellular signaling pathway in the sample; and, c. calculating a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event.

In one embodiment, the method further comprises assigning a risk of experiencing the negative clinical event based on the calculated MPS. The clinical event can be for example, but not limited to, death, disease recurrence, disease progression, development of metastasis, survival, development of cancer, for example, breast cancer.

In one embodiment, the activity level of the TGF-β cellular signaling pathway is combined with the activity level of at least the PI3K cellular signaling pathway in calculating the MPS. In one embodiment, the activity level of the TGF-β cellular signaling pathway and the activity level of at least the Wnt cellular signaling pathway in the sample are used to calculate the MPS. In one embodiment, the activity level of the TGF-β cellular signaling pathway and the activity level of at least the ER cellular signaling pathway in the sample are used to calculate the MPS. In one embodiment, the activity level of the TGF-β cellular signaling pathway and the activity level of at least the HH cellular signaling pathway in the sample are used to calculate the MPS. In one embodiment, the activity level of the TGF-β cellular signaling pathway, the activity level of the PI3K cellular signaling pathway, and the activity levels of one of the Wnt cellular signaling pathway, the ER cellular signaling pathway, or the HH cellular signaling pathway in the sample are used to calculate the MPS. In one embodiment, the activity level of the TGF-4 cellular signaling pathway, the activity level of the PI3K cellular signaling pathway, the activity level of the Wnt cellular signaling pathway, the activity level of the ER cellular signaling pathway, and the activity level of the HH cellular signaling pathway in the sample are used to calculate the MPS.

Methods for treating a subject identified as having an increased risk of experiencing a negative clinical event are also provided. For example, if the risk of the clinical event occurring increases with an increasing activity level of the TGF-β cellular signaling pathway in the sample, then the subject can be treated by administering to the subject a TGF-β inhibitor. Where the risk increases with an increasing activity level of the PI3K cellular signaling pathway in the sample, the subject may be administered a PI3K, inhibitor. Where the risk decreases with an increasing activity level of the ER cellular signaling pathway in the sample, the subject may be administered an estrogen hormone replacement therapeutic. Moreover, patients at high risk of experiencing a clinical event may receive chemotherapy in addition to standard of care treatment modalities such as, but not limited to, surgery, radiotherapy, (targeted) drug therapy. In one embodiment, the increase or decrease in risk is monotonic.

The level of the cellular signaling pathway transcription factor element can be determined using a calibrated pathway model executed by one or more computer processors, as further described below. The calibrated pathway model compares the expression levels of the at least three target genes of the specific cellular signaling pathway in the sample with expression levels of the at least three target genes in the calibrated pathway model which define a level of a cellular signaling pathway transcription factor element. In one embodiment, the calibrated pathway model is a probabilistic model incorporating conditional probabilistic relationships that compare the expression levels of the at least three target genes in the sample with expression levels of the at least three target genes in the model which define a level of a transcription factor element of a particular cellular signaling pathway to determine the level of the transcription factor element in the sample. In one embodiment, the probabilistic model is a Bayesian network model. In an alternative embodiment, the calibrated pathway model can be a linear or pseudo-linear model. In an embodiment, the linear or pseudo-linear model is a linear or pseudo-linear combination model.

The expression levels of the unique set of target genes can be determined using standard methods known in the art. For example, the expression levels of the target genes can be determined by measuring the level of mRNA of the target genes, through quantitative reverse transcriptase-polymerase chain reaction techniques, using probes associated with a mRNA sequence of the target genes, using a DNA or RNA microarray, and/or by measuring the protein level of the protein encoded by the target genes. Once the expression level of the target genes is determined, the expression levels of the target genes within the sample can be utilized in the model in a raw state or, alternatively, following normalization of the expression level data. For example, expression level data can be normalized by transforming it into continuous data, z-score data, discrete data, or fuzzy data.

The calculation of the activity level of a cellular signaling pathway in the sample is performed on a computerized device having a processor capable of executing a readable program code for calculating the TGF-β signaling in the sample according to the methods described above. The computerized device can include means for receiving expression level data, wherein the data is expression levels of at least three target genes of a TGF-β cellular signaling pathway and at least target genes of at least one additional cellular signaling pathway as described herein and derived from the sample, a means for calculating the level of the cellular signaling pathway specific transcription factor element in the sample using a calibrated pathway model, wherein the calibrated pathway model compares the expression levels of the at least three target genes in the sample with expression levels of the at least three target genes in the model which define a level of the transcription factor element; a means for calculating the cellular signaling in the sample based on the calculated level of the cellular signaling pathway specific transcription factor elements in the sample, a means for calculating an MPS score using a calibrated MPS model, wherein the calibrated NIPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event; and, optionally, a means for displaying the calculated risk score.

In accordance with another disclosed aspect, further provided herein is a non-transitory storage medium capable of storing instructions that are executable by a digital processing device to perform the method according to the present disclosure as described herein. The non-transitory storage medium may be a computer-readable storage medium, such as a hard drive or other magnetic storage medium, an optical disk or other optical storage medium, a random access memory (RAM), read only memory (ROM), flash memory, or other electronic storage medium, a network server, or so forth. The digital processing device may be a handheld device (e.g., a personal data assistant or smartphone), a notebook computer, a desktop computer, a tablet computer or device, a remote network server, or so forth.

Further described herein are methods of treating a subject identified as a risk for experiencing a clinical even associated with a particular disease or disorder. In one embodiment, the disorder is one of an auto-immune and other immune disorders, cancer, bronchial asthma, heart disease, diabetes, hereditary hemorrhagic telangiectasia, Marfan syndrome, Vascular Ehlers-Danlos syndrome, Loeys-Dietz syndrome, Parkinson's disease, Chronic kidney disease, Multiple Sclerosis, fibrotic diseases such as liver, lung, or kidney fibrosis, Dupuytren's disease, or Alzheimer's disease. In a particular embodiment, the subject is suffering from a cancer, for example, a breast cancer, lung cancer, a colon cancer, pancreatic cancer, brain cancer, or breast cancer. In a more particular embodiment, the cancer is a breast cancer.

Also described herein is a kit for measuring the expression levels of at least three or more TGF-β cellular signaling pathway target genes, and at least three or more target genes from at least one or more additional cellular signaling pathways. In one embodiment, the kit includes one or more components for measuring the expression levels of at least three or more TGF-β target genes selected from ANGPTL4, CDC42EP3, CDKN1A, CDKN2B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA. In one embodiment, the kit includes one or more components fbr measuring the expression levels of the TGF-β target genes ANGPTL4, CDC42EP3, ID1, SERPINE, JUNB, SKIL, SMAD7, CDKN1A, CTGF, GADD45B, VEGFA, and SNAI2. In one embodiment, the kit includes one or more components capable of measuring the expression levels of at least three PI3K signaling target genes selected from ATP8A1, BCL2L11, BNIP3, BTG1, C10orf10, CAT, CBLB, CCND1, CCND2, CDKN1B, DDB1, DYRK2, ERBB3, EREG, ESR1, EXT1, FASLG, FGFR2, GADD45A, IGF1R, IGFBP1, IGFBP3, INSR, LGMN, MXI1, PPM1D, SEMA3C, SEPP1, SESN1, SLC5A3, SMAD4, SOD2, TLE4, and TNFSF10. In one embodiment, the kit comprises one or more components capable of measuring the expression levels of at least three PI3K signaling target genes selected from wherein the at least three PI3K target genes are selected from AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10. In one embodiment, the kit comprises one or more components capable of measuring the expression levels of the PI3K target genes FBXO32, BCL2L11, SOD2, TNFSF10, BCL6, BTG1, CCNG2, CDKN1B, BNIP3, GADD45A, INSR, and MXI1.

In one embodiment, the kit comprises one or more components capable of measuring the expression levels of at least three Wnt target genes are selected from ADRA2C, ASCL2, AXIN2, BMP7, CCND1, CD44, COL18A1, DEFA6, DKK1, EPHB2,EPHB3, FAT1, FZD7, GLUL, HNF1A, IL8 (CXCL8), KIAA1199 (CEMIP), KLF6, LECT2, LEF1, LGR5, MYC, NKD1, OAT, PPARG, REG1B, RNF43, SLC1A2, SOX9, SP5, TBX3, TCF7L2, TDGF1, and ZNRF3. In one embodiment, the kit comprises one or more components capable of measuring the expression levels of at least three Wnt target genes are selected from CEMIP, AXIN2, CD44, RNF43, MYC, TBX3, TDGF1, SOX9, ASCL2, CXCL8, SP5, ZNRF3, EPHB2, LGR5, EPHB3, KLF6, CCND1, DEFA6, and FZD7. In one embodiment, the kit comprises one or more components capable of measuring the expression levels of the Wnt target genes AXIN2, CD44, LGR5, CEMIP, MYC, CXCL8, SOX9, EPHB3, RNF43, TDGF1, ZNRF3, and DEFA6. In one embodiment, the kit comprises one or more components capable of measuring the expression levels of at least three ER target genes are selected from AP1B1, ATP5J, COL18A1, COX7A2L, CTSD, DSCAM, EBAG9, ESR1, HSPB1, KRT19, NDUFV3, NRIP1, PGR, PISD, PRDM15, PTMA, RARA, SOD1, TFF1, TRIM25, XBP1, GREB1, IGFBP4, MYC, SGK3, WISP2, ERBB2, CA12, CDH26, and CELSR2. In one embodiment, the kit comprises one or more components capable of measuring the expression levels of at least three ER target genes selected from CDH26, SGK3, PGR, GREB1, CA12, XBP1, CELSR2, WISP2, DSCAM, ERBB2, CTSD, TFF1, PDZK1, IGFBP4, ESR1, SOD1, AP1B1 and NRIP1 In one embodiment, the kit comprises one or more components capable of measuring the expression levels of the ER target genes TFF1, GREB1, PGR, SGK3, PDZK1, IGFBP4, NRIP1, CA12, XBP1, ERBB2, ESR1, and CELSR2. In one embodiment, the kit comprises one or more components capable of measuring the expression levels of at least three HH target genes selected from PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, TCEA2, MYLK, FYN, PITRM1, CFLAR, IL1R2, S100A7, S100A9 CCND1. JAG2, FOXM1, FOXF1, and FOXL1 In one embodiment, the kit comprises one or more components capable of measuring the expression levels of at least three HH target genes selected from GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1. In one embodiment, the kit comprises one or more components capable of measuring the expression levels of the HH target genes GLI1, PTCH1, PTCH2, CCND2, IGFBP6, MYCN, FST, RAB34, GLI3, CFLAR, S100A7, and S100A9

In a specific embodiment, the kit as contemplated herein comprises one or more components capable of measuring the expression levels of:
  a. at least three TGF-β cellular signaling target genes selected from ANGPTL4, CDC42EP3, ID1, SERPINE, JUNB, SKIL, SMAD7, CDKN1A, CTGF, GADD45B, VEGFA, and SNAI2;
  b. at least three PI3K signaling target genes selected from FBXO32, BCL2L11, SOD2, TNFSF10, BCL6, BTG1, CCNG2, CDKN1B, BNIP3, GADD45A INSR, and MXI1;
  c. at least three Wnt target genes selected from AXIN2, CD44, LGR5, CEMIP, MYC, CXCL8, SOX9, EPHB3, RNF43, TDGF1, ZNRF3, and DEFA6;
  d. at least three ER target genes selected from TFF1, GREB1, PGR, SGK3, PDZK1, IGFBP4, NRIP1, CAI2, XBP1, ERBB2, ESR1, and CELSR2; and,
  e. at least three HH target genes selected from GLI1, PTCH1, PTCH2, CCND2, IGFBP6, MYCN, FST, RAB34, GLI3, CFLAR, S100A7, and S100A9.

In a particular embodiment, the kit contemplated herein comprises one or more components capable of measuring the expression levels of:
  a. TGF-β cellular signaling target genes ANGPTL4, CDC42EP3, ID1, SERPINE, JUNB, SKIL, SMAD7, CDKN1A, CTGF, GADD45B, VEGFA, and SNAI2;
  b. PI3K signaling target genes FBXO32, BCL2L11, SOD2, TNFSF10, BCL6, BTG1, CCNG2, CDKN1B, BNIP3, GADD45A, INSR, and MXI1;
  c. Wnt target genes AXIN2, CD44, LGR5, CEMIP, MYC, CXCL8, SOX9, EPHB3, RNF43, TDGF1, ZNRF3, and DEFA6,
  d. ER target genes TFF1, GREB1, PGR, SGK3, PDZK1, IGFBP4, NRIP1, CA12, XBP1, ERBB2, ESR1, and CELSR2; and,
  e. HUI target genes GLI1, PTCH1, PTCH2, CCND2, IGFBP6, MYCN, FST, RAB34, GLI3, CFLAR, S100A7, and S100A9.

As described above and contemplated herein, the one or more components or means for measuring the expression levels of the particular target genes can be selected from the group consisting of: an DNA array chip, an oligonucleotide array chip, a protein array chip, an antibody, a plurality of probes, for example, labeled probes, a set of RNA reverser-transcriptase sequencing components, and/or RNA or DNA, including cDNA, amplification primers. In one embodiment, the kit includes a set of labeled probes directed to a portion of an mRNA or cDNA sequence of the targeted genes as described herein. In one embodiment, the kit includes a set of primers and probes directed to a portion of an mRNA or cDNA sequence of the targeted genes as described further below, for example, a set of specific primers or probes selected from the sequences of Table 25-29. In one embodiment, the labeled probes are contained in a standardized 96-well plate. In one embodiment, the kit further includes primers or probes directed to a set of reference genes, for example, as represented in Table 30. Such reference genes can be, for example, constitutively expressed genes useful in normalizing or standardizing expression levels of the target gene expression levels described herein. In one embodiment, the kit for measuring the expression levels of cellular signaling target genes in a sample isolated from a subject comprises:
  a. a set of polymerase chain reaction primers directed to at least three TGF-β cellular signaling pathway target genes from a sample isolated from a subject;
  b. a set of probes directed to the at least three TGF-β cellular signaling pathway target genes derived from the sample;
  c. a set of polymerase chain reaction primers directed to a set of at least three target genes from at least one other cellular signaling pathways, wherein the other cellular signaling pathway genes are selected from PI3K cellular signaling pathway target genes, Wnt cellular signaling pathway target genes, ER cellular signaling pathway target genes, and HH cellular signaling pathway target genes; and,
  d. a set of probes directed to the at least one other cellular signaling pathway target genes, wherein the other cellular signaling pathway genes are selected from PI3K cellular signaling pathway target genes, Wnt cellular signaling pathway target genes, ER cellular signaling pathway target genes, and HH cellular signaling pathway target genes.

In one embodiment, the kit further includes a non-transitory storage medium containing instructions that are executable by a digital processing device to perform a method according to the present disclosure as described herein. In one embodiment, the kit includes an identification code that provides access to a server or computer network for analyzing the activity level of the TGF-β cellular signaling pathway based on the expression levels of the target genes and the methods described herein.

(GSE42373). (Legend: 1—2D control, 2—2D TGF-β and TNFα, 3—3D control, 4—3D TGF-β and TNFα)

Figure 33:
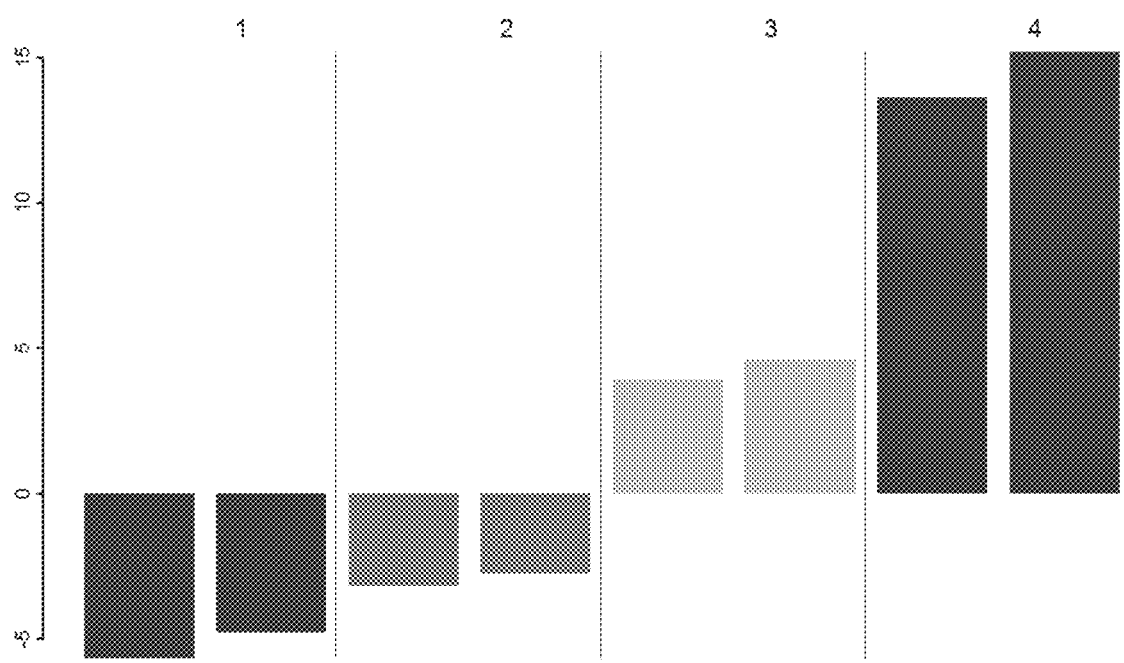

FIG. 33 shows TGF-β pathway activity predictions calculated by the '11-gene list+SERPINE1'-Bayesian network in 2D and 3D cultures of A549 lung adenocarcinoma cell lines stimulated with or without a 10 ng/mL TNF and 2 ng/mL TGF-β (GSE42373). (Legend: 1-2D control, 2—2D TGF-β and TNFα, 3-3D control, 4-3D TGF-β and TNFα)

Figure 34:
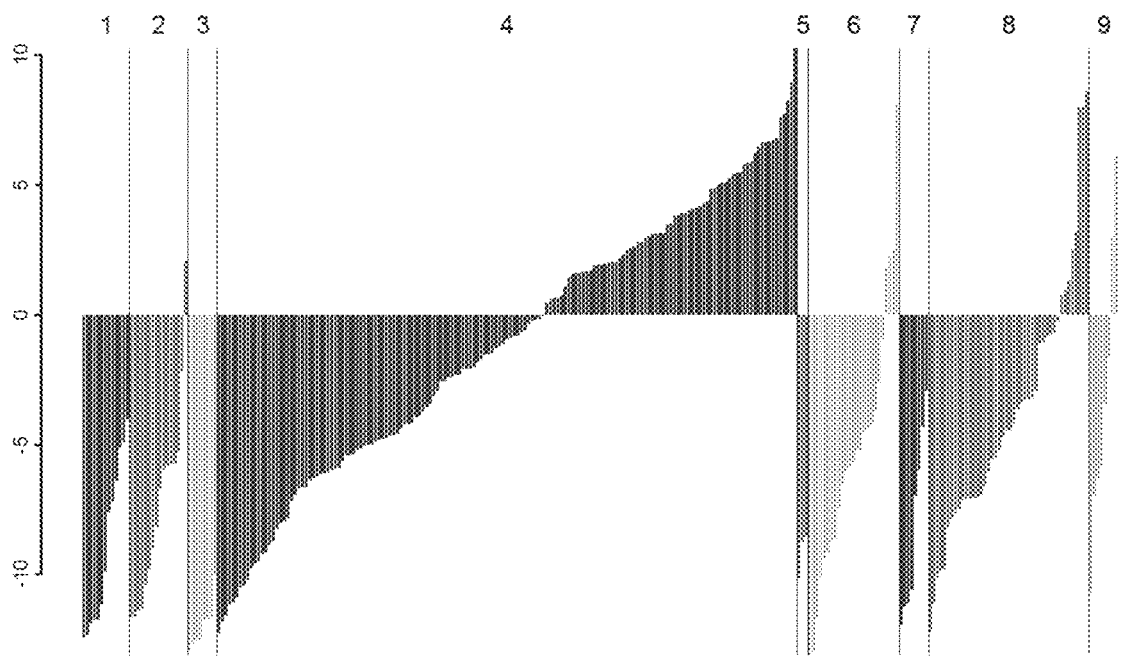

FIG. 34 shows TGF-β pathway activity predictions calculated by the '11-gene list'-Bayesian on glioma patients and some control samples from GSE16011. (Legend: 1—Astrocytoma (grade II); 2—Astrocytoma (grade III); 3—Control; 4—Glioblastoma multiforme (grade IV); 5—Oligoastrocytic (grade II); 6—Oligoastrocytic (grade III); 7—Oligodendroglial (grade II); 8—Oligodendroglial (grade III); 9—Pilocytic astrocytoma (grade I))

Figure 35:
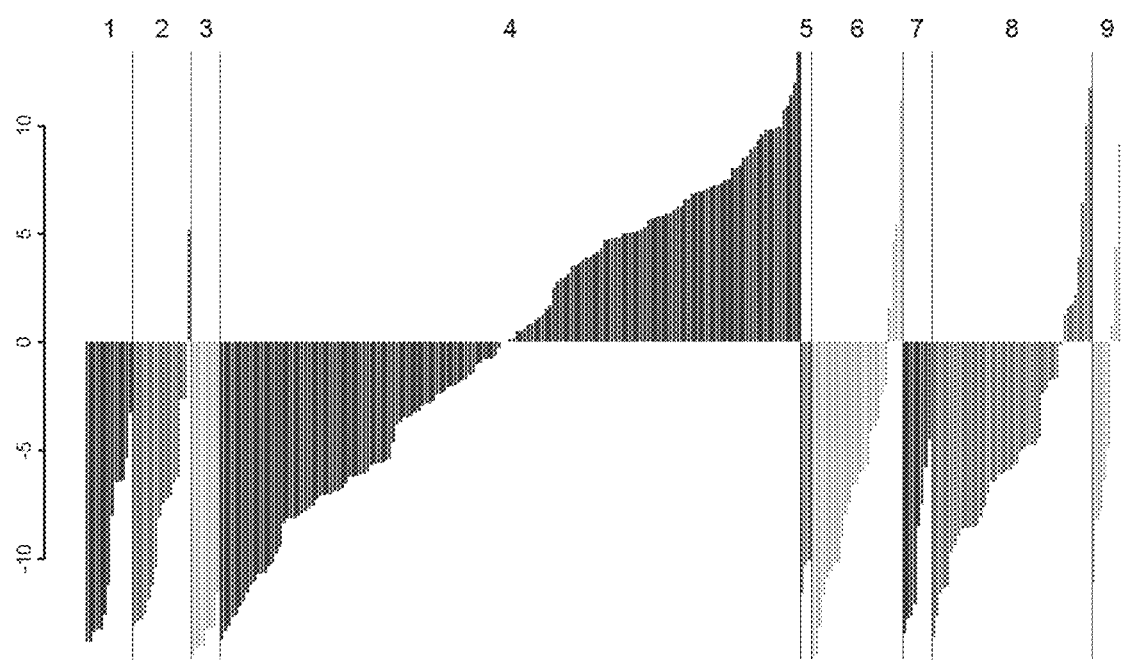

FIG. 35 shows TGF-β pathway activity predictions calculated by the '11-gene list+SERPINE1'-Bayesian on glioma patients and some control samples from GSEI6011. (Legend: 1—Astrocytoma (grade II); 2—Astrocytoma (grade III); 3—Control; 4—Glioblastoma multiforme (grade IV); 5—Oligoastrocytic (grade II); 6—Oligoastrocytic (grade III); 7—Oligodendroglial (grade II); 8—Oligodendroglial (grade III); 9—Pilocytic astrocytoma (grade I))

DETAILED DESCRIPTION OF EMBODIMENTS

In accordance with a main aspect of the present disclosure, methods and apparatuses are described that are capable of identifying a subject such as a human at risk of experiencing a negative clinical event associated with a disease within a defined period of time by determining the activity level of a transforming growth factor-β (TGF-β) cellular signaling pathway in combination with at least one other cellular signaling pathway selected from a phosphatidylinositide 3-kinase (PI3K) signaling pathway, a Wnt signaling pathway, an estrogen-receptor (ER) signaling pathway, or a hedgehog (HH) signaling pathway, using the methods described herein. It has been discovered that analyzing the activity levels of these specific cellular signaling pathways in combination using the methods described herein provides for an advantageously accurate prediction that a subject having a specific TGF-β cellular signaling pathway activity level in combination with a particular activity levels of at least one additional cellular signaling pathway will experience a certain clinical event associated with a particular disorder. This accurate risk assessment allows, for example, a clinician to develop or adjust a treatment modality to reduce or avoid the risk of developing the clinical event.

The present disclosure identifies subjects at risk for developing certain clinical events associated with a particular disease in two steps:
- a.) First determining an activity level of a TGF-β cellular signaling pathway in a sample isolated from the subject, wherein the TGF-β cellular signaling pathway activity is calculated by i) calculating an activity level of a TGF-β transcription factor element in the sample, wherein the activity level of the TGF-β transcription factor element in the sample is calculated by (1) receiving data on the expression levels of at least three TGF-β target genes derived from the sample, wherein the TGF-β transcription factor element controls transcription of the at least three TGF-β target genes, (2) calculating the activity levels of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and, ii) calculating the activity level of the TGF-β cellular signaling pathway in the sample based on the calculated activity level of the TGF-β transcription factor element in the sample.
- b.) Second, the determination of the TGF-β cellular signaling pathway activity is then analyzed in combination or in light of the activity level of at least one additional cellular signaling pathway selected from a PI3K signaling pathway, a Wnt signaling pathway, an ER signaling pathway, or a HH signaling pathway by calculating an activity level of at least one additional cellular signaling pathway in the sample, wherein the activity levels of the additional cellular signaling pathways is calculated by i) calculating an activity level of a transcription factor element from the additional cellular signaling pathway in the sample, wherein the activity level of the transcription factor element of the additional cellular signaling pathway is calculated by (1) receiving data on the expression levels of at least three target genes of the additional cellular signaling pathway derived from the sample, wherein the transcription factor element of the additional cellular signaling pathway controls transcription of the at least three target genes of the additional cellular signaling pathway, and (2) calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and ii) calculating the activity level of the additional cellular signaling pathway in the sample based on the calculated activity level of the transcription factor element of the additional cellular signaling pathway in the sample.

The activity levels of the TGF-β cellular signaling pathway and the at least one other cellular signaling pathway are then used to calculate a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event. The resultant MPS score can be used to assign a risk of experiencing the clinical event.

In some embodiments, the increase or decrease in the activity level is monotonical. In alternative embodiments, the increase or decrease is non-monotonical. Therefore, in the specification herein where the word "monotonical is used in an embodiment, in an alternative embodiment, the increase or decrease can be non-monotonical.

Definitions

All terms used herein are intended to have their plain and ordinary meaning as normally ascribed in the art unless otherwise specifically indicated herein.

Herein, the "level" of a transcription factor (TF) element denotes the level of activity of the TF element regarding transcription of its target genes.

The term "subject", as used herein, refers to any living being. In some embodiments, the subject is an animal, for example a mammal. In certain embodiments, the subject is a human being, for example a medical subject. In a particular embodiment, the subject is a human. In one embodiment, the human is suspected of having a disorder mediated or exacerbated by an active level of one or more of the cellular signaling pathways examined by the methods provided herein, for example, a cancer. In one embodiment, the human has or is suspected of having a breast cancer.

The term "sample", as used herein, also encompasses the case where e.g. a tissue and/or cells and/or a body fluid of the subject have been taken from the subject and, e.g., have been put on a microscope slide, and where for performing the claimed method a portion of this sample is extracted, e.g., by means of Laser Capture Microdissection (LCM), or by scraping off the cells of interest from the slide, or by fluorescence-activated cell sorting techniques. In addition, the term "sample", as used herein, also encompasses the case where e.g. a tissue and/or cells and/or a body fluid of the subject have been taken from the subject and have been put on a microscope slide, and the claimed method is performed on the slide. In addition, the term "samples," as used herein, may also encompass circulating tumor cells or CTCs.

The term "transcription factor element" as used herein refers to an intermediate protein or protein complex of the active transcription factor or an active transcription protein or complex which controls target gene expression.

As described herein, the present disclosure includes:

A) A computer implemented method for identifying a subject at risk of experiencing a clinical event associated with a disease within a defined period of time performed by a computerized device having a processor comprising:
   a. calculating an activity level of a transforming growth factor-β (TGF-β) cellular signaling pathway in a sample isolated from the subject, wherein the TGF-β cellular signaling pathway activity is calculated by:
      i. calculating an activity level of a TGF-β transcription factor element in the sample, wherein the activity level of the TGF-β transcription factor element in the sample is calculated by:
         1. receiving data on the expression levels of at least three TGF-β target genes derived from the sample, wherein the TGF-β transcription factor element controls transcription of the at least three TGF-β target genes,
         2. calculating the activity levels of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and,
      ii. calculating the activity level of the TGF-β cellular signaling pathway in the sample based on the calculated activity level of the TGF-β transcription factor element in the sample; and,
   b. calculating an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog signaling pathway in the sample, wherein the activity levels of the additional cellular signaling pathways is calculated by:
      i. calculating an activity level of a transcription factor element from the additional cellular signaling pathway in the sample, wherein the activity level of the transcription factor element of the additional cellular signaling pathway is calculated by:
         1. receiving data on the expression levels of at least three target genes of the additional cellular signaling pathway derived from the sample, wherein the transcription factor element of the additional cellular signaling pathway controls transcription of the at least three target genes of the additional cellular signaling pathway,
         2. calculating the activity levels of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and,
      ii. calculating the activity level of the additional cellular signaling pathway in the sample based on the calculated activity level of the transcription factor element of the additional cellular signaling pathway in the sample; and,
   c. calculating a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event; and
   d. assigning a risk of experiencing the clinical event based on the calculated MPS.

In one embodiment, the activity level of the TGF-β cellular signaling pathway and the activity level of at least the PI3K cellular signaling pathway in the sample are used to calculate the MPS. In one embodiment, the activity level of the TGF-β cellular signaling pathway and the activity level of at least the Wnt cellular signaling pathway in the sample are used to calculate the MPS. In one embodiment, the activity level of the TGF-β cellular signaling pathway and the activity level of at least the ER cellular signaling pathway in the sample are used to calculate the MPS. In one embodiment, the activity level of the TGF-β cellular signaling pathway and the activity level of at least the HH cellular signaling pathway in the sample are used to calculate the MPS. In one embodiment, the activity level of the TGF-β cellular signaling pathway, the activity level of the PI3K cellular signaling pathway, and the activity levels of one of the Wnt cellular signaling pathway, the ER cellular signaling pathway, or the HH cellular signaling pathway in the sample are used to calculate the MPS. In one embodiment, the activity level of the TGF-β cellular signaling pathway, the activity level of the PI3K cellular signaling pathway, the activity level of the Wnt cellular signaling pathway, the activity level of the ER cellular signaling pathway, and the activity level of the HH cellular signaling pathway in the sample are used to calculate the MPS. In one embodiment, the clinical event is death. In one embodiment, the clinical event is disease recurrence. In one embodiment, the clinical event is disease progression. In one embodiment, the disease is cancer. In one embodiment, the cancer is breast cancer. In one embodiment, the clinical event is the development of metastatic disease.

In one embodiment, the risk monotonically increases with an increasing activity level of the TGF-β cellular signaling pathway in the sample. In one embodiment, the additional cellular signaling pathway is at least the PI3K cellular signaling pathway and wherein the risk monotonically increases with an increasing activity level of the PI3K cellular signaling pathway in the sample. In one embodiment, the additional cellular signaling pathway is at least the Wnt cellular signaling pathway and wherein the risk monotonically increases with an increasing activity level of the Wnt cellular signaling pathway in the sample. In one embodiment, the additional cellular signaling pathway is at least the HH cellular signaling pathway, and wherein the risk monotonically increases with an increasing activity level of the HH cellular signaling in the sample. In one embodiment, the additional cellular signaling pathway is at least the ER cellular signaling pathway wherein the risk monotonically decreases with an increasing activity level of the ER cellular signaling pathway in the sample. In one embodiment, the additional cellular signaling pathway is the PI3K cellular signaling pathway, the Wnt cellular signaling pathway, the ER cellular signaling pathway, and the HH cellular signaling pathway wherein the risk monotonically increases with an increasing activity level of the TGF-β cellular signaling pathway, the PI3K cellular signaling pathway, the Wnt cellular signaling pathway, and the HH cellular signaling pathway in the sample, and monotonically decreases with an increasing activity level of the ER cellular signaling pathway in the sample. In one embodiment, the at least three TGF-β target genes are selected from ANGPTL4, CDC42EP3, CDKN1A, CDKN2B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA. In one embodiment, the at least three TGF-β target genes are selected from ANGPTL4, CDC42EP3, ID1, IL11, JUNB, SERPINE1, SKIL, or SMAD7. In one embodiment, the expression levels of the TGF-β target genes ANGPTL4, CDC42EP3, ID1, SERPINE1, JUNB, SKIL, or SMAD7 is determined. In one embodiment, the expression levels of the TGF-β target genes ANGPTL4, CDC42EP3, ID1, SERPINE1, JUNB, SKIL, SMAD7, CDKN1A, CTGF, GADD45B, VEGFA, and SNAI2 are determined. In one embodiment, the additional cellular signaling pathway is at least the PI3K cellular signaling pathway and the at least three PI3K target genes are selected from ATP8A1, BCL2L11, BNIP3, BTG1, C10orf10, CAT, CBLB, CCND1, CCND2, CDKN1B, DDB1, DYRK2, ERBB3, EREG, ESR1, EXT1, FASLG, FGFR2, GADD45A, IGF1R, IGFBP1, IGFBP3, INSR, LGMN, MXI1, PPM1D, SEMA3C, SEPP1, SESN1, SLC5A3, SMAD4, SOD2, TLE4, and TNFSF10. In one embodiment, the additional cellular signaling pathway is at least the PI3K cellular signaling pathway and wherein the at least three PI3K target genes are selected from AGRP, BCL2L11, BCL6, BNIP3, BTG1, CAT, CAV1, CCND1, CCND2, CCND2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10. In one embodiment, the additional cellular signaling pathway is at least the PI3K cellular signaling pathway and wherein the expression levels of the PI3K target genes FBXO32, BCL2L11, SOD2, TNFSF10, BCL6, BTG1, CCNG2, CDKN1B, BNIP3, GADD45A, INSR, and MXI1 are determined. In one embodiment, the additional cellular signaling pathway is at least the Wnt cellular signaling pathway and wherein the at least three Wnt target genes are selected from ADRA2C, ASCL2, AXIN2, BMP7, CCND1, CD44, COL18A1, DEFA6, DKK1, EPHB2 EPHB3, FAT1, FZD7, GLUL, HNF1A, CXCL8, CEMIP, KLF6, LECT2, LEF1, LGR5, MYC, NKD1, OAT, PPARG, REG1B, RNF43, SLC1A2, SOX9, SP5, TBX3, TCF7L2, TDGF1, and ZNRF3. In one embodiment, the additional cellular signaling pathway is at least the Wnt cellular signaling pathway and wherein the at least three Wnt target genes are selected from CEMIP, AXIN2, CD44, RNF43, MYC, TBX3, TDGF1, SOX9, ASCL2, CXCL8, SP5, ZNRF3, EPHB2, LGR5, EPHB3, KLF6, CCND1, DEFA6, and FZD7. In one embodiment, the additional cellular signaling pathway is at least the Wnt cellular signaling pathway and wherein the expression levels of the Wnt target genes AXIN2, CD44, LGR5, CEMIP, MYC, CXCL8, SOX9, EPHB3, RNF43, TDGF1, ZNRF3, and DEFA6 are determined. In one embodiment, the additional cellular signaling pathway is at least the ER cellular signaling pathway and wherein the wherein the at least three ER target genes are selected from AP1B1, ATP5J, COL18A1, COX7A2L, CTSD, DSCAM, EBAG9, ESR1, HSPB1, KRT19, NDUFV3, NRIP1, PGR, PISD, PRDM15, PTMA, RARA, SOD1, TFF1, TRIM25, XBP1, GREB1, IGFBP4, MYC, SGK3, WISP2, ERBB2, CA12, CDH26, and CELSR2. In one embodiment, the additional cellular signaling pathway is at least the ER cellular signaling pathway and wherein the at least three ER target genes are selected from CDH26, SGK3, PGR, GREB1, CA12, XBP1, CELSR2, WISP2, DSCAM, ERBB2, CTSD, TFF1, PDZK1, IGFBP4, ESR1, SOD1, AP1B1, and NRIP1. In one embodiment, the additional cellular signaling pathway is at least the ER cellular signaling pathway and wherein the expression levels of the ER target genes TFF1, GREB1, PGR, SGK3, PDZK1, IGFBP4, NRIP1, CA12, XBP1, ERBB2, ESR1, and CELSR2 are determined. In one embodiment, the additional cellular signaling pathway is at least the HH cellular signaling pathway and wherein the at least three HH target genes are selected from GLI1, PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, CTSL1, TCEA2, MYLK, FYN, PITRM1, CFLAR, IL1R2, S100A7, S100A9, CCND1, JAG2, FOXM1, FOXF1, and FOXL1. In one embodiment, the additional cellular signaling pathway is at least the HH cellular signaling pathway and wherein the at least three HH target genes are selected from GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1. In one embodiment, the additional cellular signaling pathway is at least the HH cellular signaling pathway and wherein the expression levels of the HH target genes GLI1, PTCH1, PTCH2, CCND2, IGFBP6, MYCN, FST, RAB34, GLI3, CFLAR, S100A7, and S100A9 are determined. In one embodiment, the additional cellular signaling pathway is at least the PI3K cellular signaling pathway and wherein the MPS is calculated by the following equation:

$$MPS = w_t \cdot P_t + w_p \cdot P_p,$$

wherein $P_t$ and $P_p$, denote the calculated activity of the TGF-β cellular signaling pathway and the PI3K cellular signaling pathway respectively, and wherein $w_t$ and $w_p$, are weighting coefficients representing a correlation between the activity of the TGF-β cellular signaling pathway and the PI3K cellular signaling pathway respectively to the risk of the clinical event occurring. In one embodiment, the additional cellular signaling pathway is at least the Wnt cellular signaling pathway and wherein the MPS is calculated by the following equation:

$$MPS = w_t \cdot P_t + w_w \cdot P_w$$

wherein Pt, and Pw, denote the calculated activity of the TGF-β cellular signaling pathway and the Wnt cellular signaling pathway respectively, and wherein wt and ww are weighting coefficients representing a correlation between the activity of the TGF-β cellular signaling pathway and the Wnt cellular signaling pathway respectively to the risk of the clinical event occurring. In one embodiment, the additional cellular signaling pathway is at least the ER cellular signaling pathway and wherein the MPS is calculated by the following equation:

$$MPS = w_t \cdot P_t + w_e \cdot P_e$$

wherein $P_t$, and $P_e$ denote the calculated activity of the TGF-β cellular signaling pathway and the ER cellular signaling pathway respectively, and wherein $w_t$ and $w_e$ are weighting coefficients representing a correlation between the activity of the TGF-β cellular signaling pathway and the ER cellular signaling pathway respectively to the risk of the clinical event occurring. In one embodiment, the additional cellular signaling pathway is at least the HH cellular signaling pathway and wherein the MPS is calculated by the following equation:

$$MPS = w_t \cdot P_t + w_h \cdot P_h$$

wherein $P_t$ and $P_h$ denote the calculated activity of the TGF-41 cellular signaling pathway and the HH cellular signaling pathway respectively, and wherein $w_t$ and $w_h$ are weighting coefficients representing a correlation between the activity of the TGF-β cellular signaling pathway and the HH cellular signaling pathway respectively to the risk of a clinical event occurring. In one embodiment, the additional cellular signaling pathway is the PI3K cellular signaling pathway, the Wnt cellular signaling pathway, the ER cellular signaling pathway, and the HH cellular signaling pathway, and wherein the MPS is calculated by the following equation:

$$MPS = w_t \cdot P_t + w_p \cdot P_p + w_w \cdot P_w + w_e \cdot P_e + w_h \cdot P_h$$

wherein $P_t$, $P_p$, $P_w$, $P_e$, and $P_h$ denote the calculated activity of the TGF-β cellular signaling pathway, the PI3K cellular signaling pathway, the Wnt cellular signaling pathway, the ER cellular signaling pathway, and the HH cellular signaling pathway respectively, and wherein $w_t$, $w_p$, $w_w$, $w_e$, and $w_h$ are weighting coefficients representing a correlation between the activity of the TGF-β cellular signaling pathway, the PI3K cellular signaling pathway, the Wnt cellular signaling pathway, the ER cellular signaling pathway, and the HIT cellular signaling pathway respectively to the risk of the clinical event occurring. In one embodiment, the weighting coefficients $w_t$ and $w_p$ are calculated using a Cox's proportional hazard model, Wherein the Cox's proportional hazard model is fitted to a training set of samples with calculated activities $P_t$ and $P_p$ and survival data. In one embodiment, the weighting coefficients $w_t$ and $w_w$ are calculated using a Cox's proportional hazard model, wherein the Cox's proportional hazard model is fitted to a training set of samples with calculated activities $P_t$ and $P_w$ and survival data. In one embodiment, the weighting coefficients $w_t$ and $w_e$ are calculated using a Cox's proportional hazard model, wherein the Cox's proportional hazard model is fitted to a training set of samples with calculated activities $P_t$ and $P_e$ and survival data. In one embodiment, the weighting coefficients $w_t$ and $w_h$ are calculated using a Cox's proportional hazard model, wherein the Cox's proportional hazard model is fitted to a training set of samples with calculated activities $P_t$ and $P_h$ and survival data. In one embodiment, the weighting coefficients $w_t$, $w_p$, $w_w$, $w_e$ and $w_h$ are calculated using a Cox's proportional hazard model, wherein the Cox's proportional hazard model is fitted to a training set of samples with calculated activities $P_t$, $P_p$, $P_w$, $P_e$, and $P_h$ and survival data. In one embodiment, the risk score is the MPS. In one embodiment, the risk score is used to prescribe a course of treatment to decrease the risk of the clinical event occurring.

B) A computer program product for identifying a subject at risk of experiencing a negative clinical event associated with a disease within a defined period of time comprising:
  a. a non-transitory computer readable storage medium having computer readable program code embodied therewith, the computer readable program code executable by at least one processor to:
    i. calculate activity level of a transforming growth factor-β (TGF-β) cellular signaling pathway in a sample isolated from the subject, wherein the TGF-β cellular signaling pathway activity is calculated by:
      1. calculating an activity level of a TGF-β transcription factor element in the sample, wherein the activity level of the TGF-β transcription factor element in the sample is calculated by:
        a. receiving data on the expression levels of at least three TGF-β target genes derived from the sample, wherein the TGF-β transcription factor element controls transcription of the at least three TGF-β target genes,
        b. calculating the activity level of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element and,
      2. calculating the activity level of the TGF-β cellular signaling pathway in the sample based on the calculated activity level of the TGF-β transcription factor element in the sample; and,
    ii. calculate an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity levels of the additional cellular signaling pathways is calculated by:
  a. calculating an activity level of a transcription factor element from the additional cellular signaling pathway in the sample, wherein the activity level of the transcription factor element of the additional cellular signaling pathway is calculated by:
    i. receiving data on the expression levels of at least three target genes of the additional cellular signaling pathway derived from the sample, wherein the transcription factor element of the additional cellular signaling pathway controls transcription of the at least three target genes of the additional cellular signaling pathway,
    ii. calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and,
  b. calculating the activity level of the additional cellular signaling pathway in the sample based on the calculated activity level of the transcription factor element of the additional cellular signaling pathway in the sample; and,
  iii. calculate a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event.

In one embodiment, the computer readable program code is executable by at least one processor to assign a risk of experiencing the clinical event based on the calculated MPS. In one embodiment, the computer readable program code is executable by at least one processor to display the risk of experiencing the clinical event.

C) A method of treating a subject suffering from a disease, wherein the disease places the subject at risk of experiencing a clinical event in a defined period of time, comprising:
  a. receiving information regarding the risk that the subject will experience a clinical event within a defined period of time associated with the disease, wherein the risk is determined by:
    i. calculating an activity level of a transforming growth factor-β (TGF-β) cellular signaling pathway in a sample isolated from the subject, wherein the TGF-β cellular signaling pathway activity is calculated by:
      1. calculating an activity level of a TGF-β transcription factor element in the sample, wherein the activity level of the TGF-β transcription factor element in the sample is calculated by:
        a. receiving data on the expression levels of at least three TGF-β target genes derived from the sample, wherein the TGF-β transcription factor element controls transcription of the at least three TGF-β target genes,
        b. calculating the activity level of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and,
      2. calculating the activity level of the TGF-β cellular signaling pathway in the sample based on the calculated activity level of the TGF-β transcription factor element in the sample; and,
    ii. calculating an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity levels of the additional cellular signaling pathways is calculated by:
      1. calculating an activity level of a transcription factor element from the additional cellular signaling pathway in the sample, wherein the activity level of the transcription factor element of the additional cellular signaling pathway is calculated by:
        a. receiving data on the expression levels of at least three target genes of the additional cellular signaling pathway derived from the sample, wherein the transcription factor element of the additional cellular signaling pathway controls transcription of the at least three target genes of the additional cellular signaling pathway,
        b. calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and,
      2. calculating the activity level of the additional cellular signaling pathway in the sample based on the calculated activity level of the transcription factors element of the additional cellular signaling pathway in the sample; and,
    iii. calculating a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event; and iv. assigning a risk of experiencing the clinical event based on the calculated MPS; and, b. administering to the subject a treatment based on the risk that the subject will experience the clinical event within the certain period of time.

In one embodiment, the activity level of the TGF-β cellular signaling pathway and the activity level of at least the PI3K cellular signaling pathway in the sample are used to calculate the MPS. In one embodiment, the activity level of the TGF-β cellular signaling pathway and the activity level of at least the Wnt cellular signaling pathway in the sample are used to calculate the MPS. In one embodiment, the activity level of the TGF-β cellular signaling pathway and the activity level of at least the ER cellular signaling pathway in the sample are used to calculate the MPS. In one embodiment, the activity level of the TGF-β cellular signaling pathway and the activity level of at least the HH cellular signaling pathway in the sample are used to calculate the MPS. In one embodiment, the activity level of the TGF-β cellular signaling pathway, the activity level of the PI3K cellular signaling pathway, and the activity levels of one of the Wnt cellular signaling pathway, the ER cellular signaling pathway, or the HH cellular signaling pathway in the sample are used to calculate the MPS. In one embodiment, the activity level of the TGF-β cellular signaling pathway, the activity level of the PI3K cellular signaling pathway, the activity level of the Wnt cellular signaling pathway, the activity level of the ER cellular signaling pathway, and the activity level of the HH cellular signaling pathway in the sample are used to calculate the MPS. In one embodiment, the clinical event is death. In one embodiment, the clinical event is disease recurrence. In one embodiment, the clinical event is disease progression. In one embodiment, the disease is cancer. In one embodiment, the cancer is breast cancer. In one embodiment, the clinical event is the development of metastatic disease. In one embodiment, the risk monotonically increases with an increasing activity level of the TGF-β cellular signaling pathway in the sample. In one embodiment, if the risk is increased due to an activity level of the TGF-β cellular signaling pathway in the sample, administering to the subject a TGF-β cellular signaling pathway inhibitor. In one embodiment, the additional cellular signaling pathway is at least the PI3K cellular signaling pathway and wherein the risk monotonically increases with an increasing activity level of the PI3K cellular signaling pathway in the sample. In one embodiment, if the risk is increased due to an activity level of the PI3K cellular signaling pathway in the sample, administering to the subject a PI3K cellular signaling pathway inhibitor. In one embodiment, the additional cellular signaling pathway is at least the Wnt cellular signaling pathway and wherein the risk monotonically increases with an increasing activity level of the Wnt cellular signaling pathway in the sample. In one embodiment, if the risk is increased due to an activity level of the Wnt cellular signaling pathway in the sample, administering to the subject a Wnt cellular signaling pathway inhibitor. In one embodiment, the additional cellular signaling pathway is at least the ER cellular signaling pathway and wherein the risk monotonically decreases with an increasing activity level of the ER cellular signaling pathway in the sample. In one embodiment, if the risk is decreased due to an activity level of the ER cellular signaling pathway in the sample, administering to the subject hormone therapy. In one embodiment, the additional cellular signaling pathway is at least the HR cellular signaling pathway and wherein the risk monotonically increases with an increasing activity level of the HH cellular signaling pathway in the sample. In one embodiment, if the risk is increased due to an activity level of the HH cellular signaling pathway in the sample, administering to the subject a HH cellular signaling pathway inhibitor. In one embodiment, the additional cellular signaling pathway is the PI3 cellular signaling pathway, the Wnt cellular signaling pathway, the ER cellular signaling pathway, and the HH cellular signaling pathway wherein the risk monotonically increases with an increasing activity level of the TGF-β cellular signaling pathway, the PI3K cellular signaling pathway, the Wnt cellular signaling pathway, and the HH cellular signaling pathway in the sample, and monotonically decreases with an increasing activity level of the ER cellular signaling pathway in the sample. In one embodiment, the at least three TGF-β target genes are selected from ANGPTL4, CDC42EP3, CDKN1A, CDKN2B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA. In one embodiment, the at least three TGF-β target genes are selected from ANGPTL4, CDC42EP3, ID1, IL11, JUNB, SERPINE1, SKIL, or SMAD7. In one embodiment, the expression levels of the TGF-β target genes ANGPTL4, CDC42EP3, ID1, SERPINE1, JUNB, SKIL, or SMAD7 is determined. In one embodiment, the expression levels of the TGF-β target genes ANGPTL4, CDC42EP3, ID1, SERPINE1, JUNB, SKIL, SMAD7, CDKN1A, CTGF, GADD45B, VEGFA, and SNAI2 are determined. In one embodiment, the additional cellular signaling pathway is at least the PI3K, cellular signaling pathway and wherein the at least three PI3K target genes are selected from ATP8A1, BCL2L11, BNIP3, BTG1, C10orf10, CAT, CBLB, CCND1, CCND2, CDKN1B, DDB1, DYRK2, ERBB3, EREG, ESR1, EXT1, FASLG, FGFR2, GADD45A, IGF1R, IGFBP1, IGFBP3, INSR, LGMN, MXI1, PPM1D, SEMA3C, SEPP1, SESN1, SLC5A3, SMAD4, SOD2, TLE4, and TNFSF10. In one embodiment, the additional cellular signaling pathway is at least the PI3K cellular signaling pathway and wherein the at least three PI3K target genes are selected from AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10. In one embodiment, the additional cellular signaling pathway is at least the PI3K cellular signaling pathway and wherein the expression levels of the PI3K target genes FBXO32, BCL2L11, SOD2, TNFSF10, BCL6 BTG1, CCNG2, CDKN1B, BNIP3, GADD45A, INSR, and MXI1 are determined. In one embodiment, the additional cellular signaling pathway is at least the Wnt cellular signaling pathway and wherein the at least three Wnt target genes are selected from ADRA2C, ASCL2, AXIN2, BMP7, CCND1, CD44, COL18A1, DEFA6, DKK1, EPHB2, EPHB3, FAT1, FZD7, GLUL, HNF1A, CXCL8, CEMIP, KLF6, LECT2, LEF1, LGR5, MYC, NKD1, OAT, PPARG, REG1B, RNF43, SLC1A2, SOX9, SP5, TBX3, TCF7L2, TDGF1, and ZNRF3. In one embodiment, the additional cellular signaling pathway is at least the Wnt cellular signaling pathway and wherein the at least three Wnt target genes are selected from CEMIP, AXIN2, CD44, RNF43, MYC, TBX3, TDGF1, SOX9, ASCL2, CXCL8, SP5, ZNRF3, EPHB2, LGR5, EPHB3, KLF6, CCND1, DEFA6, and FZD7. In one embodiment, the additional cellular signaling pathway is at least the Wnt cellular signaling pathway and wherein the expression levels of the Wnt target genes AXIN2, CD44, LGR5, CEMIP, MYC, CXCL8, SOX9, EPHB3, RNF43, TDGF1, ZNRF3, and DEFA6 are determined. In one embodiment, the additional cellular signaling pathway is at least the ER cellular signaling pathway and wherein the at least three ER target genes are selected from AP1B1, ATP5J, COL18A1, COX7A2L, CTSD, DSCAM, EBAG9, ESR1, HSPB1, KRT19, NDUFV3, NRIP1, PGR, PISD, PRDM15, PTMA, RARA, SOD1, TFF1, TRIM25, XBP1, GREB1, IGFBP4, MYC, SGK3, WISP2, ERBB2, CA12, CDH26, and CELSR2. In one embodiment, the additional cellular signaling pathway is at least the ER cellular signaling pathway and wherein the at least three ER target genes are selected from CDH26, SGK3, PGR, GREB1, CA12, XBP1, CELSR2, WISP2, DSCAM, ERBB2, CTSD, TFF1, PDZK1, IGFBP4, ESR1, SOD1, AP1B1, and NRIP1. In one embodiment, the additional cellular signaling pathway is at least the ER cellular signaling pathway and wherein the expression levels of the ER target genes TFF1, GREB1, PGR, SGK3, PDZK1, IGFBP4, NRIP1, CA12, XBP1, ERBB2, ESR1, and CELSR2 are determined. In one embodiment, the additional cellular signaling pathway is at least the HH cellular signaling pathway and wherein the at least three HH target genes are selected from GLI1, PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, CTSL1, TCEA2, MYLK, FYN, PITRM1, CFLAR, IL1R2, S100A7, S100A9, CCND1, JAG2, FOXM1, FOXF1, and FOXL1. In one embodiment, the additional cellular signaling pathway is at least the HH cellular signaling pathway and wherein the at least three HH target genes are selected from GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1. In one embodiment, the additional cellular signaling pathway is at least the HH cellular signaling pathway and wherein the expression levels of the HH target genes GLI1, PTCH1, PTCH2, CCND2, IGFBP6, MYCN, FST, RAB34, GLI3, CFLAR, S100A7, and S100A9 are determined. In one embodiment, the additional cellular signaling pathway is at least the PI3K cellular signaling pathway and wherein the MPS is calculated by the following equation:

$$MPS = w_t \cdot P_t + w_p \cdot P_p$$

wherein $P_t$ and $P_p$ denote the calculated activity of the TGF-β cellular signaling pathway and the PI3K cellular signaling pathway respectively, and wherein $w_t$ and $w_p$, are weighting coefficients representing a correlation between the activity of the TGF-β cellular signaling pathway and the PI3K cellular signaling pathway respectively to the risk of the Clinical event occurring. In one embodiment, the additional cellular signaling pathway is at least the Wnt cellular signaling pathway and wherein the MPS is calculated by the following equation:

$$MPS = w_t \cdot P_t + w_w \cdot P_w$$

wherein $P_t$ and $P_w$ denote the calculated activity of the TGF-β cellular signaling pathway and the Wnt cellular signaling pathway respectively, and wherein $w_t$ and $w_w$ are weighting coefficients representing a correlation between the activity of the TGF-β cellular signaling pathway and the Wnt cellular signaling pathway respectively to the risk of the clinical event occurring. In one embodiment, the additional cellular signaling pathway is at least the ER cellular signaling pathway and wherein the MPS is calculated by the following equation:

$$MPS = w_t \cdot P_T + w_e \cdot P_e$$

wherein $P_t$ and $P_e$ denote the calculated activity of the TGF-β cellular signaling pathway and the ER cellular signaling pathway respectively, and wherein $w_t$ and $w_e$ are weighting coefficients representing a correlation between the activity of the TGF-β cellular signaling pathway and the ER cellular signaling pathway respectively to the risk of the clinical event occurring. In one embodiment, the additional cellular signaling pathway is at least the HH cellular signaling pathway and wherein the MPS is calculated by the following equation:

$$MPS = w_t \cdot P_t + w_h \cdot P_h$$

wherein $P_t$ and $P_h$ denote the calculated activity of the TGF-β cellular signaling pathway and the HH cellular signaling pathway respectively, and wherein $w_t$ and $w_h$ are weighting coefficients representing a correlation between the activity of the TGF-β cellular signaling pathway and the HH cellular signaling pathway respectively to the risk of a clinical event occurring. In one embodiment, the additional cellular signaling pathway is the PI3K cellular signaling pathway, the Wnt cellular signaling pathway, the ER cellular signaling pathway, and the HH cellular signaling pathway, and wherein the MPS is calculated by the following equation:

$$MPS = w_t \cdot P_t + w_p \cdot P_p + w_w \cdot P_w + w_e \cdot P_e + w_h \cdot P_h$$

wherein $P_t$, $P_p$, $P_w$, $P_e$, and $P_h$ denote the calculated activity of the TGF-β cellular signaling pathway, the PI3K cellular signaling pathway, the Wnt cellular signaling pathway, the ER cellular signaling pathway, and the HH cellular signaling pathway respectively, and wherein $w_t$, $w_p$, $w_w$, $w_e$ and $w_h$ are weighting coefficients representing a correlation between the activity of the TGF-β cellular signaling pathway, the PI3K cellular signaling pathway, the Wnt cellular signaling pathway, the ER cellular signaling pathway, and the HH cellular signaling pathway respectively to the risk of the clinical event occurring. In one embodiment, the weighting coefficients $w_t$ and $w_p$ are calculated using a Cox's proportional hazard model, wherein the Cox's proportional hazard model is fitted to a training set of samples with calculated activities $P_t$ and $P_p$ and survival data. In one embodiment, the weighting coefficients $w_t$ and $w_w$ are calculated using a Cox's proportional hazard model, wherein the Cox's proportional hazard model is fitted to a training set of samples with calculated activities $P_t$ and $P_w$ and survival data. In one embodiment, the weighting coefficients $w_t$ and $w_e$ are calculated using a Cox's proportional hazard model, wherein the Cox's proportional hazard model is fitted to a training set of samples with calculated activities $P_t$ and $P_e$ and survival data. In one embodiment, the weighting coefficients $w_t$ and $w_h$ are calculated using a Cox's proportional hazard model, wherein the Cox's proportional hazard model is fitted to a training set of samples with calculated activities $P_t$ and $P_h$ and survival data. In one embodiment, the weighting coefficients $w_t$, $w_p$, $w_w$, $w_e$ and $w_h$ are calculated using a Cox's proportional hazard model, wherein the Cox's proportional hazard model is fitted to a training set of samples with calculated activities $P_t$, $P_p$, $P_w$, $P_e$, and $P_h$ and survival data. In one embodiment, the risk score is the MPS.

D) A kit for identifying a subject at risk of experiencing a clinical event associated with a disease within a defined period of time comprising:
a. one or more components capable of measuring the expression levels of a set of at least three TGF-β cellular signaling target genes, wherein the at least three TGF-β target genes are selected from ANGPTl4, CDC42EP3, CDKN1A, CDKN2B, CTGF, GADD45A, GADD45B, HMGA2, ID1, IL11, SERPINE1, INPP5D, JUNB, mMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA;

b. one or more components capable of measuring the expression levels of a set of at least one other cellular signaling pathway target genes, wherein the other cellular signaling pathway target genes are selected from PI3K cellular signaling pathway target genes, Wnt cellular signaling pathway target genes, ER cellular signaling pathway target genes, and HH cellular signaling pathway target genes; and, c. a non-transitory computer readable storage medium having computer readable program code embodied therewith, the computer readable program code executable by at least one processor to:

i. calculate activity level of a transforming growth factor-β (TGF-β) cellular signaling pathway in a sample isolated from the subject, wherein the TGF-β cellular signaling pathway activity is calculated by:

1. calculating an activity level of a TGF-33 transcription factor element in the sample, wherein the activity level of the TGF-β transcription factor element in the sample is calculated by:

a. receiving data on the expression levels of at least three TGF-β target genes derived from the sample, wherein the TGF-β transcription factor element controls transcription of the at least three TGF-β target genes, b. calculating the activity level of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and, 2. calculating the activity level of the TGF-β cellular signaling pathway in the sample based on the calculated activity level of the TGF-β transcription factor element in the sample; and, ii. calculate an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity levels of the additional cellular signaling pathways is calculated by:

1. calculating an activity level of a transcription factor element from the additional cellular signaling pathway in the sample, wherein the activity level of the transcription factor element of the additional cellular signaling pathway is calculated by:

a. receiving data on the expression levels of at least three target genes of the additional cellular signaling pathway derived from the sample, wherein the transcription factor element of the additional cellular signaling pathway controls transcription of the at least three target genes of the additional cellular signaling pathway, b. calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and, 2. calculating the activity level of the additional cellular signaling pathway in the sample based on the calculated activity level of the transcription factor element of the additional cellular signaling pathway in the sample; and, iii. calculate a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event.

In one embodiment, the TGF-β target genes are selected from ANGPTL4, CDC42EP3, CDKN1A, CDKN2B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA. In one embodiment, the TGF-β target genes are ANGPTL4, CDC42EP3, ID1, SERPINE1, JUNB, SKIL, SMAD7, CDKN1A, CTGF, GADD45B, VEGFA, and SNAI2. In one embodiment, the kit comprises one or more components capable of measuring the expression levels of at least three PI3K signaling target genes selected from ATP8A1, BCL2L11, BNIP3, BTG1, C10orf10, CAT, CBLB, CCND1, CCND2, CDKN1B, DDB1, DYRK2, ERBB3, EREG, ESR1 EXT1, FASLG, FGFR2, GADD45A, IGF1R, IGFBP1, IGFBP3, INSR, LGMN, MXI1, PPM1D, SEMA3C, SEPP1, SESN1, SLC5A3, SMAD4, SOD2, TLE4, and TNFSF10. In one embodiment, the kit comprises one or more components capable of measuring the expression levels of at least three PI3K signaling target genes selected from wherein the at least three PI3K target genes are selected from AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10. In one embodiment, the kit comprises one or more components capable of measuring the expression levels of the PI3K, target genes FBXO32, BCL2L11, SOD2, TNFSF10, BCL6, BTG1, CCNG2, CDKN1B, BNIP3, GADD45A, INSR, and MXI1. In one embodiment, the kit comprises one or more components capable of measuring the expression levels of at least three Wnt target genes are selected from ADRA2C, ASCL2, AXIN2, BMP7, CCND1, CD44, COL18A1, DEFA6, DKK1, EPHB2, EPHB3, FAT1, FZD7, GLUL, HNF1A, CXCL8, CEMIP, KLF6, LECT2, LEF1, LGR5, NKD1, OAT, PPARG, REG1B, RNF43, SLC1A2, SOX9, SP5, TBX3, TCF7L2, TDGF1, and ZNRF3. In one embodiment, the kit comprises one or more components capable of measuring the expression levels of at least three Wnt target genes are selected from CEMIP, AXIN2, CD44, RNF43, MYC, TBX3, TDGF1, SOX9, ASCL2, CXCL8, SP5, ZNRF3, EPHB2, LGR5, EPHB3, KLF6, CCND1, DEFA6, and FZD7. In one embodiment, the kit comprises one or more components capable of measuring the expression levels of the Wnt target genes AXIN2, CD44, LGR5, CEMIP, MYC, CXCL8, SOX9, EPHB3, RNF43, TDGF1, ZNRF3, and DEFA6. In one embodiment, the kit comprises one or more components capable of measuring the expression levels of at least three ER target genes are selected from AP1B1, ATP5J, COL18A1, COX7A2L, CTSD, DSCAM, EBAG9, ESR1, HSPB1, KRT19 NDUFV3, NRIP1, PGR, PISD, PRDM15, PTMA, RARA, SOD1, TFF1, TRIM25, XBP1, GREB1, IGFBP4, MYC, SGK3, WISP2, ERBB2, CA12, CDH26, and CELSR2. In one embodiment, the kit comprises one or more components capable of measuring the expression levels of at least three ER target genes are selected from CDH26, SGK3, PGR, GREB1, CA12, XBP1, CELSR2, WISP2, DSCAM, ERBB2, CTSD, TFF1, PDZK1, IGFBP4, ESR1, SOD1, AP1B1, and NRIP1. In one embodiment, the kit comprises one or more components capable of measuring the expression levels of the ER target genes TFF1, GREB1, PGR, SGK3, PDZK1, IGFBP4, NRIP1, CA12, XBP1, ERBB2, ESR1, and CELSR2. In one embodiment, the kit comprises one or more components capable of measuring the expression levels of at least three HH target genes are selected from GLI1, PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, CTSL1, TCEA2, MYLK, FYN, PITRM1, CFLAR, IL1R2, S100A7, S100A9, CCND1, JAG2, FOXM1, FOXF1, and FOXL1. In one embodiment, the kit comprises one or more components capable of measuring the expression levels of at least three HH target genes are selected from GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1. In one embodiment, the kit comprises one or more components capable of measuring the expression levels of the HH target genes GLI1, PTCH1, PTCH2, CCND2, IGFBP6, MYCN, FST, RAB34, GLI3, CFLAR, S100A7, and S100A9. In one embodiment, the kit comprises one or more components capable of measuring the expression levels of:
  a. at least three TGF-β cellular signaling target genes selected from ANGPTL4, CDC42EP3, ID1, SERPINE1, JUNB, SKIL, SMAD7 CDKN1A, CTGF, GADD45B, VEGFA, and SNAI2;
  b. at least three PI3K signaling target genes selected from FBXO32, BCL2L11, SOD2, TNFSF10, BCL6, BTG1, CCNG2 CDKN1B, BNIP3, GADD45A, INSR, and MXI1;
  c. at least three Wnt target genes selected from AXIN2, CD44, LGR5, CEMIP, MYC, CXCL8, SOX9 EPHB3, RNF43, TDGF1 ZNRF3 and DEFA6;
  d. at least three ER target genes selected from TFF1, GREB1, PGR, SGK3, PDZK1, IGFBP4, NRIP1, CA12, XBP1, ERBB2, ESR1, and CELSR2; and,
  e. at least three HH target genes selected from GLI1, PTCH1 PTCH2, CCND2, IGFBP6, MYCN, FST, RAB34, GLI3, CFLAR, S100A7, and S100A9.

In one embodiment, the kit comprises one or more components capable of measuring the expression levels of:
  a. TGF-β cellular signaling target genes ANGPTL4, CDC42EP3, ID1, SERPINE1, JUNB, SKIL, SMAD7, CDKN1A, CTGF, GADD45B, VEGFA and SNAI2;
  b. PI3K signaling target genes FBXO32, BCL2L11, SOD2, TNFSF10, BCL6, BTG1, CCNG2, CDKN1B, BNIP3, GADD45A, INSR, and MXI1;
  c. Wnt target genes AXIN2, CD44, LGR5, CEMIP, MYC, CXCL8, SOX9 EPHB3, RNF43, TDGF1 ZNRF3, and DEFA6;
  d. ER target genes TFF1, GREB1, PGR, SGK3, PDZK1, IGFBP4, NRIP1, CA12, XBP1, ERBB2, ESR1, and CELSR2; and,
  e. HH target genes GLI1, PTCH1 PTCH2, CCND2, IGFBP6, MYCN, FST, RAB34, GLI3, CFLAR, S100A7, and S100A9.

E) A kit for measuring the expression levels of cellular signaling target genes in a sample isolated from a subject comprising:
  a. a set of polymerase chain reaction primers directed to at least three TGF-β cellular signaling pathway target genes from a sample isolated from a subject;
  b. a set of probes directed to the at least three TGF-β cellular signaling pathway target genes;
  c. a set of polymerase chain reaction primers directed to a set of at least three target genes from at least one other cellular signaling pathways, wherein the other cellular signaling pathway genes are selected from PI3K cellular signaling pathway target genes, Wnt cellular signaling pathway target genes, ER cellular signaling pathway target genes, and HH cellular signaling pathway target genes; and,
  d. a set of probes directed to the at least one other cellular signaling pathway target genes.

In one embodiment, the TGF-β target genes are selected from ANGPTL4, CDC42EP3, CDKN1A, CDKN1B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA. In one embodiment, the TGF-β target genes are ANGPTL4, CDC42EP3, ID1, SERPINE1, JUNB, SKIL, SMAD7, CDKN1A, CTGF, GADD45B, VEGFA, and SNAI2. In one embodiment, the kit comprises primers and probes directed to at least three PI3K signaling target genes selected from ATP8A1, BCL2L11, BNIP3, BTG1, C10orf10, CAT, CBLB, CCND1, CCND2, CDKN1B, DDB1, DYRK2, ERBB3, EREG, ESR1, EXT1, FASLG, FGFR2, GADD45A, IGF1R, IGFBP1, IGFBP3, INSR, LGMN, MX1.1, PPM1D, SEMA3C, SEPP1, SESN1, SLC5A3, SMAD4, SOD2, TLE4, and TNFSF10. In one embodiment, the kit comprises primers and probes directed to at least three PI3K signaling target genes selected from wherein the at least three PI3K target genes are selected from AG-RP, BCL2L11, BCL6 BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3 RBL2, SOD2, and TNFSF10. In one embodiment, the kit comprises primers and probes directed to the PI3K target genes FBXO32, BCL2L11, SOD2, TNFSF10, BCL6, BTG1, CCNG2, CDKN1B, BNIP3, GADD45A, INSR, and MXI1. In one embodiment, the kit comprises primers and probes directed to at least three Wnt target genes are selected from ADRA2C, ASCL2, AXIN2, BMP7, CCND1, CD44, COL18A1, DEFA6, DKK1, EPHB2, EPHB3, FAT1, FZD7, GLUL, HNF1A, CXCL8, CEMIP, KLF6, LECT2, LEF1, LGR5, MYC, NKD1, OAT, PPARG, REG1B, RNF43, SLC1A2, SOX9, SP5, TBX3, TCF7L2, TDGF1 and ZNRF3. In one embodiment, the kit comprises primers and probes directed to at least three Wnt target genes are selected from CEMIP, AXIN2, CD44, RNF43, MYC, TBX3, TDGF1, SOX9, ASCL2, CXCL8, SP5, ZNRF3, EPHB2, LGR5, EPHB3, KLF6, CCND1, DEFA6, and FZD7. In one embodiment, the kit comprises primers and probes directed to the Wnt target genes AXIN2, CD44, LGR5, CEMIP, MYC, CXCL8, SOX9, EPHB3, RNF43, TDGF1, ZNRF3, and DEFA6. In one embodiment, the kit comprises primers and probes directed to at least three ER target genes are selected from AP1B1, ATP5J, COL18A1, COX7A2L, CTSD, DSCAM, EBAG9, ESR1, HSPB1, KRT19, NDUFV3, NRIP1, PGR, PISD, PRDMI5, PTMA, RARA, SOD1, TFF1, TRIM25, XBP1, GREB1, IGFBP4, MYC, SGK3, WISP2, ERBB2, CA12, CDH26, and CELSR2. In one embodiment, the kit comprises primers and probes directed to at least three ER target genes are selected from CD1H26 SGK3, PGR, GREB1, CA12, XBP1, CELSR2, WISP2, DSCAM, ERBB2, CTSD TFF1 PDZK1, IGFBP4, ESR1, SOD1, AP1B1, and NRIP1. In one embodiment, the kit comprises primers and probes directed to the ER target genes TFF1, GREB1, PGR, SGK3, PDZK1, IGFBP4, NRIP1, CA12, XBP1, ERBB2, ESR1 and CELSR2. In one embodiment, the kit comprises primers and probes directed to at least three HH target genes are selected from GLI1, PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, CTSL1, TCEA2 MYLK, FYN, PITRM1, CFLAR, IL1R2, S100A7, S100A9, CCND1, JAG2, FOXM1, FOXF1, and FOXL1. In one embodiment, the kit comprises primers and probes directed to at least three HH target genes are selected from GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1. In one embodiment, the kit comprises primers and probes directed to the HH target genes GLI1, PTCH1, PTCH2, CCND2, IGFBP6 MYCN, FST, RAB34, GLI3, CFLAR, S100A7, and S100A9. In one embodiment, the kit comprises primers and probes directed to:

a. at least three TGF-β cellular signaling target genes selected from ANGPTL4, CDC42EP3, ID1, SERPINE1, JUNB, SKIL, SMAD7, CDKN1A, CTGF, GADD45B, VEGFA, and SNAI2;
b. at least three PI3K signaling target genes selected from FBXO32, BCL2L1.1, SOD2, TNFSF10, BCL6, BTG1, CCNG2, CDKN1B, BNIP3, GADD45A, INSR, and MXI1;
c. at least three Wnt target genes selected from AXIN2, CD44, LGR5, CEMIP, MYC, CXCL8, SOX9, EPHB3, RNF43, TDGF1 ZNRF3, and DEFA6;
d. at least three ER target genes selected from TFF1, GREB1, PGR, SGK3. PDZK1, IGFBP4, NRIP1, CA12, XBP1, ERBB2, ESR1, and CELSR2;
e. at least three HH target genes selected from GLI1, PTCH1, PTCH2, CCND2, IGFBP6, MYCN, FST, RAB34, GLI3, CFLAR, S100A7, and S100A9.

In one embodiment, the kit comprises primers and probes directed to:
a. TGF-β cellular signaling target genes ANGPTL4, CDC42EP3, ID1, SERPINE1, JUNB, SKIL, SMAD7, CDKN1A, CTGF, GADD4513, VEGFA, and SNAI2;
b. PI3K signaling target genes FBXO32, BCL2L11, SOD2, TNFSF10, BCL6, BTG1, CCNG2, CDKN1B, BNIP3, GADD45A, INSR, and MXI1;
c. Wnt target genes AXIN2, CD44, LGR5, CEMIP, MYC, CXCL8, SOX9, EPHB3, RNF43, TDGF1, ZNRF3, and DEFA6;
d. ER target genes TFF1, GREB1, PGR, SGK3, PDZK1, IGFBP4, NRIP1, CA12, XBP1, ERBB2, ESR1, and CELSR2; and,
e. HH target genes GLI1, PTCH1, PTCH2, CCND2, IGFBP6, MYCN, FST, RAB34, GLI3, CFLAR, S100A7, and S100A9.

In one embodiment, the kit includes a non-transitory computer readable storage medium having computer readable program code embodied therewith, the computer readable program code executable by at least one processor to:

a. calculate activity level of a transforming growth factor-β (TGF-β) cellular signaling pathway in a sample isolated from the subject, wherein the TGF-β cellular signaling pathway activity is calculated by:
  i. calculating an activity level of a TGF-β transcription factor element in the sample, wherein the activity level of the TGF-β transcription factor element in the sample is calculated by:
    1. receiving data on the expression levels of at least three TGF-β target genes derived from the sample, wherein the TGF-β transcription factor control transcription of the at least three TGF-β target genes,
    2. calculating the activity levels of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and,
  ii. calculating the activity level of the TGF-β cellular signaling pathway in the sample based on the calculated activity level of the TGF-β transcription factor element in the sample; and,
b. calculate an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity levels of the additional cellular signaling pathways is calculated by:
  i. calculating an activity level of a transcription factor element from the additional cellular signaling pathway in the sample, wherein the activity level of the transcription factor element of the additional cellular signaling pathway is calculated by:
    1. receiving data on the expression levels of at least three target genes of the additional cellular signaling pathway derived from the sample, wherein the transcription factor element of the additional cellular signaling pathway controls transcription of the at least three target genes of the additional cellular signaling pathway,
    2. calculating the activity level of the transcription factor element of the additional cellular signaling pathway in the sample using a calibrated pathway model, wherein the calibrated pathway model compares the expression levels of the at least three target genes from the additional cellular signaling pathway in the sample with expression levels of the at least three target genes from the additional cellular signaling pathway in the calibrated pathway model which define an activity level of the transcription factor element of the additional cellular signaling pathway; and, ii. calculating the activity level of the additional cellular signaling pathway in the sample based on the calculated activity level of the transcription factors element of the additional cellular signaling pathway in the sample; and, c. calculate a risk score using a calibrated Multi-Pathway Score (MPS) model, wherein the calibrated MPS model compares the calculated activity level of the TGF-β cellular signaling pathway and the calculated activity level of the additional cellular signaling pathway in the sample with an activity level of a TGF-β cellular signaling pathway and activity level of the additional cellular signaling pathway determinative of the occurrence of the clinical event.

Generalized Workflow for Determining the Activity Level of TGF-β, PI3K, Wnt, ER, and HH Cellular Signaling The present disclosure provides new and improved methods and apparatuses as disclosed herein, to assess the functional state or activity of the TGF-β, PI3K, Wnt, ER, and 111-1 cellular signaling pathways in order to calculate a risk score of a subject experiencing a particular clinical event.

Figure 20:
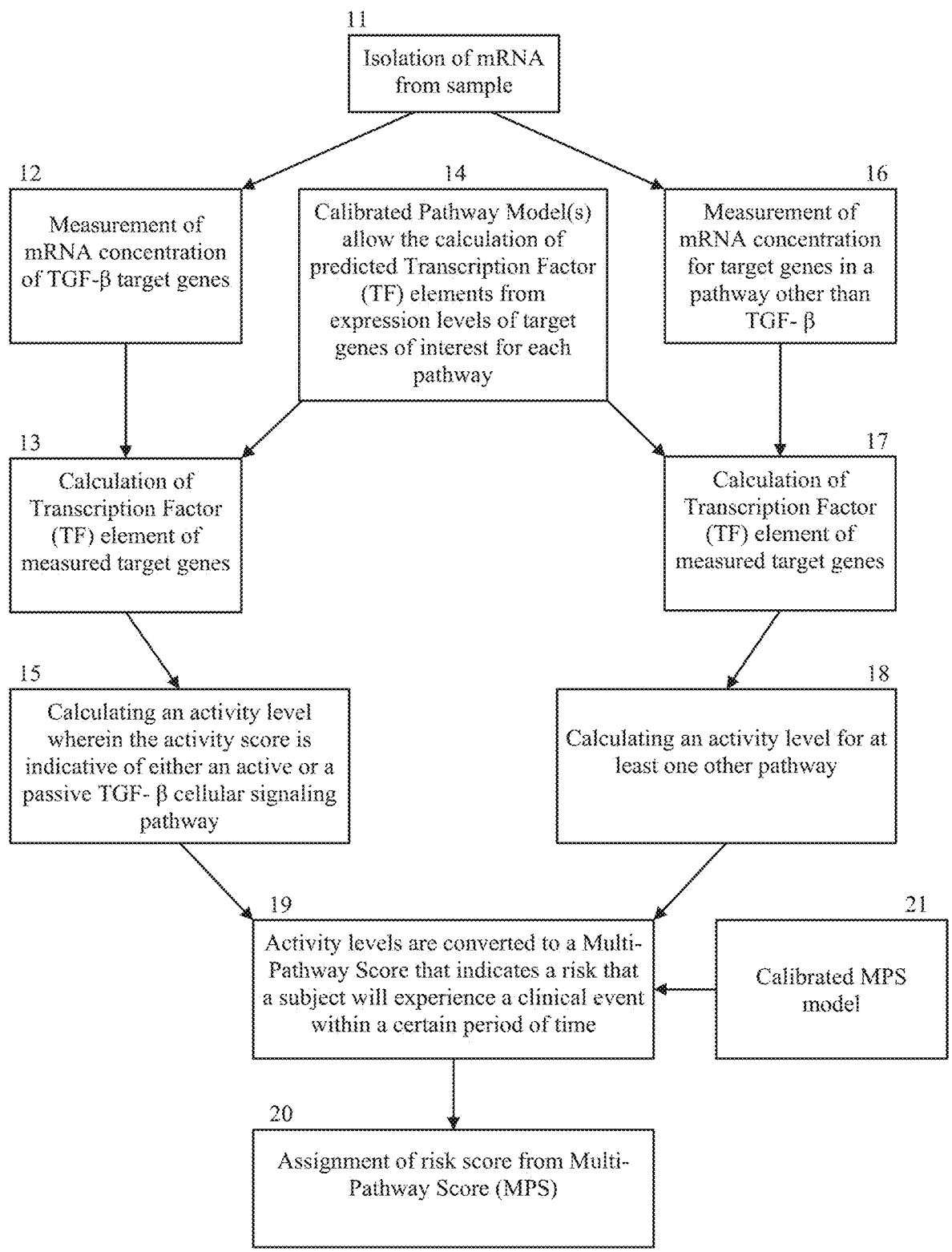
FIG. 20 shows a non-limiting exemplary flow chart for calculating the risk score based on the measurement of the expression levels of target genes of the TGF-β cellular signaling pathway and additional cellular signaling pathways.

An example flow chart illustrating an exemplary calculation of the activity level of TGF-β cellular signaling and other cellular signaling from a sample isolated from a subject is provided in FIG. 20. First, the mRNA from a sample is isolated (11). Second, the mRNA expression levels of a unique set of at least three or more TGF-β target genes, as described herein, are measured (12) using methods for measuring gene expression that are known in the art. Next, the calculation of a transcription factor element (13) is calculated using a calibrated pathway model (14), wherein the calibrated pathway model compares the expression levels of the at least three or more target genes in the sample with expression levels of the at least three target genes in the calibrated pathway model which have been correlated with a level of a TGF-β transcription factor element. Next, the activity level of the TGF-β cellular signaling pathway is calculated in the sample based on the calculated level of the TGF-β transcription factor element in the sample (15).

As shown on the right hand side of FIG. 20, after calculating the TGF-β transcription factor element, a transcription factor element for at least one additional cellular signaling pathways (i.e. PI3K, Wnt, ER, and HH) are determined. As an example, the mRNA expression levels of a unique set of at least three or more target genes from at least one additional cellular signaling pathways, as described herein, are measured (16) using methods for measuring gene expression that are known in the art. Next, the calculation of the transcription factor element (17) is calculated using a calibrated pathway model (14), wherein the calibrated pathway model compares the expression levels of the at least three or more target genes in the sample with expression levels of the at least three target genes in the calibrated pathway model which have been correlated with a level of a the transcription factor element. Next, the activity level of other cellular signaling pathways (i.e. PI3K, Wnt, ER, and HH) is calculated in the sample based on the calculated levels of the transcription factor element in the sample (18). Next, the activity level of the TGF-β and the other cellular signaling pathways is converted to a Multi-Pathway Score (MPS) using a calibrated MPS model (21) that indicates a risk that a subject will experience a clinical event within a certain period of time (19). Finally, the sample is assigned a risk score for experiencing a clinical event based on the calculated MPS (20).

Target Genes

The present disclosure utilizes the analyses of the expression levels of unique sets of target genes. Particularly suitable target genes are described in the following text passages as well as the examples below (see, e.g., Tables 1-21 below).

Thus, according to a preferred embodiment the target gene(s) is/are selected from the group consisting of the target genes listed in Table 1, Table 2, Table 3, Table 4, Table 5, Table 6, Table 7, Table 8, Table 9, Table 10, Table 11, Table 12, Table 13, Table 14, Table 15, Table 16, Table 17, Table 18, Table 19. Table 20, or Table 21, below.

Provided herein is a method of identifying a subject at risk of experiencing a clinical event associated with a disease within a defined period of time comprising the steps of:

determining the activity of the TGF-β pathway in the subject based at least on expression levels of one or more (e.g. one or more, two or more, three or more, four or more, five or more, six or more, seven or more, eight or more, nine or more, ten or more, eleven or more, twelve or more, etc.) target genes of the TGF-β pathway measured in the sample of the subject selected from the group consisting of: ANGPTL4, CDC42EP3, CDKN1A, CDKN2B, CTGF, GADD45A, GADD45B, HMGA2, ID1, IL11, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA, or ANGPTL4, CDC42EP3, CDKN1A, CDKN2B, CTGF, GADD45A, GADD45B, HMGA2, ID1, IL11, SERPINE1, INPP5D, JUNB, MMP9, NKX2-5, OVOL1, PDGFB, PTHLH, SGK1, SKIL, SMAD4, SMAD5, SMAD6, SMAD7, SNAI1, SNAI2, TIMP1, and VEGFA, or from the group consisting of: ANGPTL4, CDC42EP3, CDKN1A, CTGF, GADD45A, GADD45B, HMGA2, ID1, IL11, JUNB, PDGFB, PTHLH, SGK1, SKIL, SMAD4, SMAD5, SMAD6, SMAD7, SNAI2, and VEGFA, or ANGPTL4, CDC42EP3, CDKN1A, CTGF, GADD45A, GADD45B, HMGA2, ID1, SERPINE1, JUNB, PDGFB, PTHLH, SGK1, SKIL, SMAD4, SMAD5, SMAD6, SMAD7, SNAI2, and VEGFA, or from the group consisting of: ANGPTL4, CDC42EP3, CDKN1A, CTGF, GADD45B, ID1, IL11, JUNB, PDGFB, SKIL, SMAD7, and SNAI2, or ANGPTL4, CDC42EP3, CDKN1A, CTGF, GADD45B, ID1, SERPINE1, JUNB, VEGFA, SKIL, SMAD7, and SNAI2, or from the group consisting of: ANGPTL4, CDC42EP3, ID1, IL11, JUNB, SKIL, and SMAD7, or ANGPTL4, CDC42EP3, ID1, SERPINE1, JUNB, SKIL, and SMAD7, and/or determining the activity of the PI3K pathway in the subject based at least on expression levels of one or more (i.e. one or more, two or more, three or more, four or more, five or more, six or more, seven or more, eight or more, nine or more, ten or more, eleven or more, twelve or more, etc.) target gene(s) of the PI3K pathway measured in the sample of the subject selected from the group consisting of: AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10, and/or determining the activity of the Wnt pathway in the subject based at least on expression levels of one or more (i.e. one or more, two or more, three or more, four or more, five or more, six or more, seven or more, eight or more, nine or more, ten or more, eleven or more, twelve or more, etc.) target gene(s) of the Wnt pathway measured in the sample of the subject selected from the group consisting of: KIAA1199 (CEMIP), AXIN2, CD44, RNF43, MYC, TBX3, TDGF1, SOX9, ASCL2, IL8 (CXCL8), SP5, ZNRF3, EPHB2, LGR5, EPHB3, KLF6, CCND1, DEFA6, and FZD7, and/or determining the activity of the ER pathway in the subject based at least on expression levels of one or more (i.e. one or more, two or more, three or more, four or more, five or more, six or more, seven or more, eight or more, nine or more, ten or more, eleven or more, twelve or more, etc.) target gene(s) of the ER pathway measured in the sample of the subject selected from the group consisting of: GREB1, PGR, XBP1, CA12, SOD1, CTSD, IGFBP4, TFF1, SGK3, NRIP1, CELSR2, WISP2, AP1B1, PDZK1, ERBB2, and ESR1, and/or determining the activity of the HH pathway in the subject based at least on expression levels of one or more (i.e. one or more, two or more, three or more, four or more, five or more, six or more, seven or more, eight or more, nine or more, ten or more, eleven or more, twelve or more, etc.) target gene(s) of the HH pathway measured in the sample of the subject selected from the group consisting of GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1.

Provided herein is a method of identifying a subject at risk of experiencing a clinical event associated with a disease within a defined period of time comprising the steps of:

determining the activity of the TGF-β pathway in the subject based at least on expression levels of one or more, two or more, or at least three, target genes of the TGF-β pathway measured in the sample of the subject selected from the group consisting of: ANGPTL4, CDC42EP3, CDKN1A, CTGF, GADD45B, ID1, SERPINE1, JUNB, VEGFA, SKIL, SMAD7, and SNAI2, and/or determining the activity of the PI3K pathway in the subject based at least on expression levels of one or more, two or more, or at least three, target gene(s) of the PI3K pathway measured in the sample of the subject selected from the group consisting of: BCL2L11, BCL6, BNIP3, BTG1, CCND2, CDKN1B, FBXO32, GADD45A, INSR, SOD2, and TNFSF10, and/or determining the activity of the Wnt pathway in the subject based at least on expression levels of one or more, two or more, or at least three, target gene(s) of the Wnt pathway measured in the sample of the subject selected from the group consisting of: KIAA1199 (CEMIP), AXIN2, CD44, RNF43, MYC, TDGF1, SOX9, IL8 (CXCL8), ZNRF3, LGR5, EPHB3, and DEFA6, and/or determining the activity of the ER pathway in the subject based at least on expression levels of one or more, two or more, or at least three, target gene(s) of the ER pathway measured in the sample of the subject selected from the group consisting of: GREB1, PGR, XBP1, CA12, IGFBP4, TFF1, SGK3, NRIP1, CELSR2, PDZK1, ERBB2, and ESR1, and/or determining the activity of the HH pathway in the subject based at least on expression levels of one or more, two or more, or at least three, target gene(s) of the HH pathway measured in the sample of the subject selected from the group consisting of: GLI1, PTCH1, PTCH2, IGFBP6, CCND2, FST, CFLAR, RAB34, S100A9, S100A7, MYCN, and GLI3.

Provided herein is a method which comprises:

calculating the activity of the two or more cellular signaling pathways based at least on the expression levels of one or more target gene(s) of the cellular signaling pathways measured in a sample of the subject.

Provided herein is a method wherein the calculating comprises:

calculating the activity of the TGF-β pathway in the subject based at least on expression levels of one or more, two or more, or at least three, target gene(s) of the TGF-β pathway measured in the sample of the subject selected from the group consisting of: ANGPTL4, CDC42EP3, CDKN1A, CDKN2B, CTGF, GADD45A, GADD45B, HMGA2, ID1, IL11, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA, or from the group consisting of: ANGPTL4, CDC42EP3, CDKN1A, CTGF, GADD45A, GADD45B, HMGA2, ID1, IL11, JUNB, PDGFB, PTHLH, SGK1, SKIL, SMAD4, SMAD5, SMAD6, SMAD7, SNAI2, and VEGFA, or from the group consisting of: ANGPTL4, CDC42EP3, CDKN1A, CTGF, GADD45B, ID1, IL11, JUNB, PDGFB, SKIL, SMAD7, and SNAI2, or from the group consisting of: ANGPTL4, CDC42EP3, ID1, IL11, JUNB, SKIL, and SMAD7, and/or calculating the activity of the PI3K pathway in the subject based at least on expression levels of one or more, two or more, or at least three, target gene(s) of the PI3K pathway measured in the sample of the subject selected from the group consisting of: AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10, and/or calculating the activity of the Wnt pathway in the subject based at least on expression levels of one or more, two or more, or at least three, target gene(s) of the Wnt pathway measured in the sample of the subject selected from the group consisting of: KIAA1199, AXIN2, CD44, RNF43, MYC, TBX3, TDGG1, SOX9, ASCL2, IL8, SP5, ZNRF3, EPHB2, LGR5, EPHB3, KLF6, CCND1, DEFA6, and FZD7, and/or calculating the activity of the ER pathway in the subject based at least on expression levels of one or more, two or more, or at least three, target gene(s) of the ER pathway measured in the sample of the subject selected from the group consisting of: GREB1, PGR, XBP1, CA12, SOD1, CTSD, IGFBP4, TFF1, SGK3, NRIP1, CELSR2, WISP2, and AP1B1, and/or calculating the activity of the HH pathway in the subject based at least on expression levels of one or more, two or more, or at least three, target gene(s) of the HH pathway measured in the sample of the subject selected from the group consisting of: GLI1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1.

In one embodiment, the calculating is further based on:

(i) expression levels of at least one target gene of the PI3K pathway measured in the sample of the subject selected from the group consisting of: ATP8A1, C10orf10, CBLB, DDB1, DYRK2, ERBB3, EREG, EXT1, FGFR2, IGF1R, IGFBP1, IGFBP3, LGMN PPM1D, SEMA3C, SEPP1, SESN1, SLC5A3, SMAD4, and TLE4, and/or (ii) expression levels of at least one target gene of the PI3K pathway measured in the sample of the subject selected from the group consisting of: ATG14, BIRC5, IGFBP1, KLF2, KLF4, MYOD1, PDK4, RAG1, RAG2, SESN1, SIRT1, STK11 and TXNIP, and/or expression levels of at least one target gene of the Wnt pathway measured in the sample of the subject selected from the group consisting of: NKD1, OAT, FAT1, LEF1, GLUL, REG1B, TCF7L2, COL18A1, BMP7, SLC1A2, ADRA2C, PPARG, DKK1, HNF1A, and LECT2, and/or expression levels of at least one target gene of the ER pathway measured in the sample of the subject selected from the group consisting of: RARA, MYC, DSCAM, EBAG9, COX7A2L, ERBB2, PISD, KRT19, HSPB1, TRIM25, PTMA, COL18A1, CDH26, NDUFV3, PRDM15, ATP5J, and ESR1, and/or expression levels of at least one target gene of the HH pathway measured in the sample of the subject selected from the group consisting of: BCL2, FOXA2, FOXF1, H19, HHIP, IL1R2, JAG2, JUP, MIF, MYLK, NKX2.2, NKX2.8, PITRM1, and TOM1.

In one embodiment, the TGF-β target genes are selected from the group consisting of: ANGPTL4, CDC42EP3, CDKN1A, CDKN2B, CTGF, GADD45A, GADD4513, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA.

In one embodiment, the PI3K target genes are selected from the group consisting of: ATP8A1, BCL2L11, BNIP3, BTG1, C10orf10, CAT, CBLB, CCND1, CCND2, CDKN1B, DDB1, DYRK2, ERBB3, EREG, ESR1, EXT1, FASLG, FGFR2, GADD45A, IGF1R, IGFBP1, IGFBP3, INSR, LGMN, MXI1, PPM1D, SEMA3C, SEPP1, SESN1, SLC5A3, SMAD4, SOD2, TLE4, and TNFSF10.

In one embodiment, the Wnt target genes are selected from the group consisting of: ADRA2C, ASCL2, AXIN2, BMP7, CCND1, CD44, COL18A1, DEFA6, DKK1, EPHB2, EPHB3, FAT1, FZD7, GLUL, HNF1A, IL8, KIAA1199 (CEMIP), KLF6, LECT2, LEF1, LGR5, MYC, NKD1, OAT, PPARG, REG1B, RNF43, SLC1A2. SOX9, SP5, TBX3, TCF7L2, TDGF1, and ZNRF3.

In one embodiment, the ER target genes are selected from the group consisting of: AP1B1, ATP5J, COL18A1, COX7A2L, CTSD, DSCAM, EBAG9, ESR1, HSPB1, KRT19, NDUFV3, NRIP1, PGR, PISD, PRDM15, PTMA, RARA, SOD1, TFF1, TRIM25, XBP1, GREB1, IGFBP4, MYC, SGK3, WISP2, ERBB2, CA12, CDH26, and CELSR2.

In one embodiment, the HH target genes are selected from the group consisting of: DLII PTCH1, PTCH2, HHIP, SPP1, TSC22D1, CCND2, H19, IGFBP6, TOM1, JUP, FOXA2, MYCN, NKX2-2, NKX2-8, RAB34, MIF, GLI3, FST, BCL2, CTSL1, TCEA2, MYLK, FYN, PITRM1, CFLAR, IL1R2, S100A7, S100A9, CCND1, JAG2, FOXM1, FOXF1, and FOXL1.

If the calculating of the activity of the PI3K pathway is further based both on expression levels of at least one target gene of the PI3K pathway selected from the group (i) and on expression levels of at least one target gene of the PI3K pathway selected from the group (ii), the target genes IGFBP1 and SESN1, which are mentioned above with respect to both groups, may only be contained in one of the groups.

The "target gene(s)" are for example "direct target genes" and/or "indirect target genes" (as described herein).

Measuring Levels of Gene Expression

Data derived from the unique set of target genes described herein is further utilized to determine the activity level of the cellular signaling pathways using the methods described herein.

Methods for analyzing gene expression levels in isolated samples are generally known. For example, methods such as Northern blotting, the use of PCR, nested PCR, quantitative real-time PCR (qPCR), RNA-sect, or microarrays can all be used to derive gene expression level data. All methods known in the art for analyzing gene expression of the target genes are contemplated herein.

Methods of determining the expression product of a gene using PCR based methods may be of particular use. In order to quantify the level of gene expression using PCR, the amount of each PCR product of interest is typically estimated using conventional quantitative real-time PCR. (qPCR) to measure the accumulation of PCR products in real time after each cycle of amplification. This typically utilizes a detectible reporter such as an intercalating dye, minor groove binding dye, or fluorogenic probe whereby the application of light excites the reporter to fluoresce and the resulting fluorescence is typically detected using a CCD camera or photomultiplier detection system, such as that disclosed in U.S. Pat. No. 6,713,297 which is hereby incorporated by reference.

In some embodiments, the probes used in the detection of PCR products in the quantitative real-time PCR (qPCR) assay can include a fluorescent marker. Numerous fluorescent markers are commercially available. For example, Molecular Probes, Inc. (Eugene, Oreg.) sells a wide variety of fluorescent dyes. Non-limiting examples include Cy5, Cy3, TAMRA, R6G, R110, ROX, JOE, FAM, Texas Red™, and Oregon Green™. Additional fluorescent markers can include IDT ZEN Double-Quenched Probes with traditional 5' hydrolysis probes in qPCR assays. These probes can contain, for example, a 5' FAM dye with either a 3' TAMRA Quencher, a 3' Black Hole Quencher (BHQ, Biosearch Technologies), or an internal ZEN Quencher and 3' Iowa Black Fluorescent Quencher (IBFQ).

Fluorescent dyes useful according to the disclosure can be attached to oligonucleotide primers using methods well known in the art. For example, one common way to add a fluorescent label to an oligonucleotide is to react an N-Hydroxysticcinimide (NHS) ester of the dye with a reactive amino group on the target. Nucleotides can be modified to carry a reactive amino group by, for example, inclusion of an allyl amine group on the nucleobase. Labeling via allyl amine is described, for example, in U.S. Pat. Nos. 5,476,928 and 5,958,691, which are incorporated herein by reference. Other means of fluorescently labeling nucleotides, oligonucleotides and polynucleotides are well known to those of skill in the art.

Other fluorogenic approaches include the use of generic detection systems such as SYBR-green dye, which fluoresces when intercalated with the amplified DNA from any gene expression product as disclosed in U.S. Pat. Nos. 5,436,134 and 5,658,751 which are hereby incorporated by reference.

Another useful method for determining target gene expression levels includes RNA-seq, a powerful analytical tool used for transcriptome analyses, including gene expression level difference between different physiological conditions, or changes that occur during development or over the course of disease progression.

Another approach to determine gene expression levels includes the use of microarrays for example RNA and DNA microarray, which are well known in the art. Microarrays can be used to quantify the expression of a large number of genes simultaneously.

Calibration of Multi-Pathway Score (MPS) Model and Calculation of Multi-Pathway Risk Score (MPS)

As contemplated herein, a risk score corresponding to the risk that a clinical event will occur can be determined using a calibrated Multi-Pathway Score (MPS) model containing activity levels of the cellular signaling pathways determinative of the occurrence of the clinical event, as further described below. The calibrated MPS model compares the calculated activity level of the TGF-β cellular signaling pathway and the calculated activity levels of one or more of the PI3K cellular signaling pathway, Wnt cellular signaling pathway, ER cellular signaling pathway or HH cellular signaling pathway in the sample with an activity level of a TGF-β cellular signaling pathway and activity levels of one or more of a PI3K, Wnt, ER, or HH cellular signaling pathway determinative of the occurrence of the clinical event.

Figure 21:
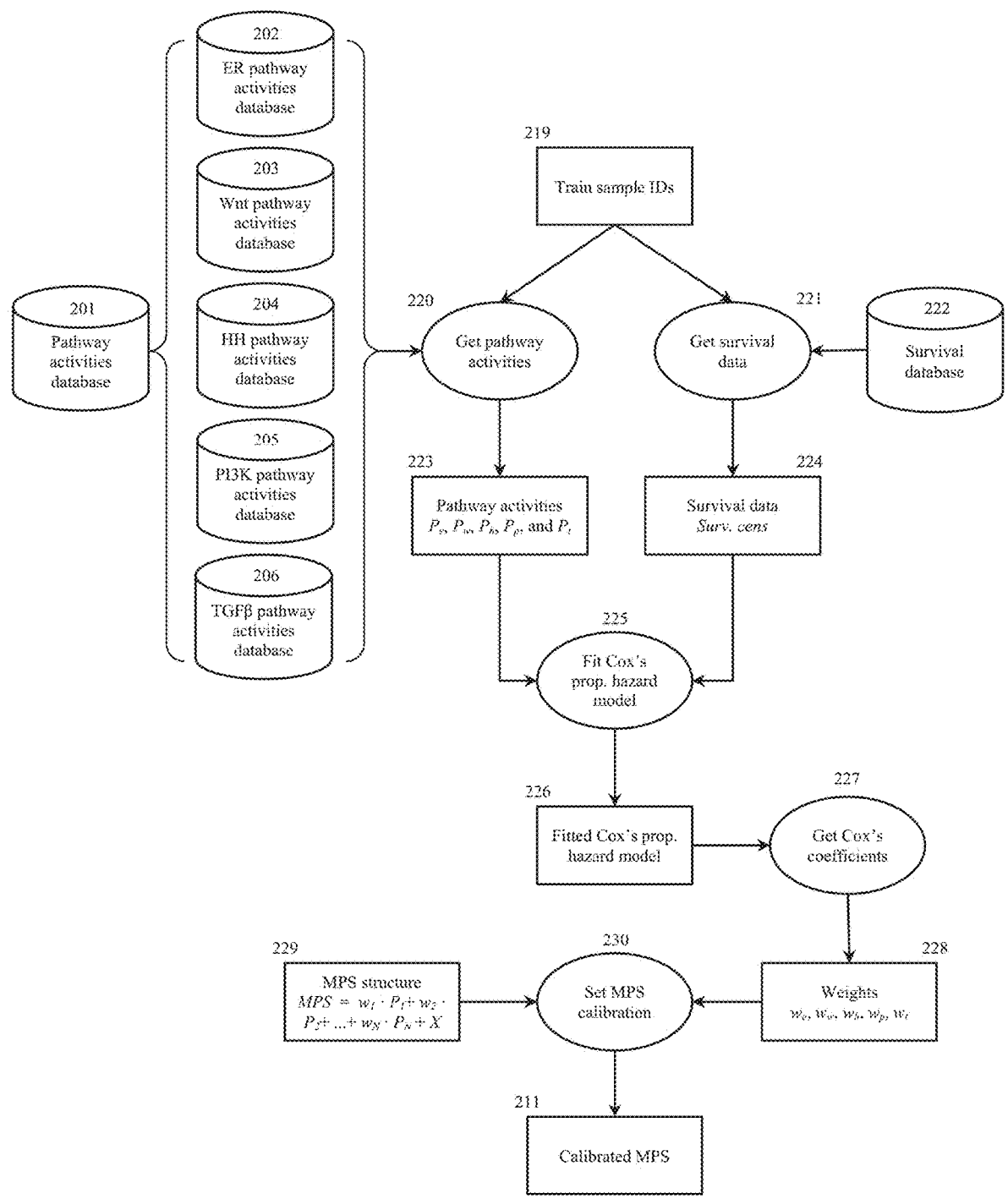
FIG. 21 is a non-limiting exemplary flow chart for calibrating a Multi-Pathway Score (MPS) model with survival data.

A calibrated Multi-Pathway Score (MPS) model as used in the present disclosure can be calibrated with readily available clinical data on the clinical event of interest and the calculated pathway activities. A non-limiting exemplary flow chart for calibrating a MPS model with survival data is shown in FIG. 21. As an initial step, relevant pathway activities calculated using calibrated pathway models are retrieved from a pathway activities database. (201). The pathway activities database contains TGF-β pathway activities (206) and the pathway activities for at least one additional pathway. For example, the pathway activities database contains ER pathway activities (202), Wnt pathway activities (203), HH pathway activities (204), PI3K pathway activities (205), and TGF-41 pathway activities (206). The IDs of a particular training set of samples (219) is then employed to receive the relevant pathway activities (220) and, for example, survival data (221) (if survival is the clinical event being analyzed) which is received from a survival data database (222). The pathway activities are then selected (223) with an output of $P_e$, $P_w$, $P_h$, $P_p$, and $P_t$ in case of ER pathway activities, Wnt pathway activities, HH pathway activities, PI3K pathway activities and TGF-β pathway activities, respectively. The survival data is converted to the variables Surv and cens (224) reflecting the survival time and censoring data within a given time period that the MPS will be used for. The pathway activities and survival data are then fit to a Cox's proportional hazard model (225) which results in a fitted. Cox's proportional hazard model (226). From the Cox's proportional hazard model the Cox's coefficients are collected (227) and then assigned to weights (228) with the output $w_e$, $w_w$, $w_h$, $w_p$, and $w_t$. The MPS structure (229) and weights are taken together to calibrate the MPS model (230) outputting a calibrated MPS model (211).

Figure 22:
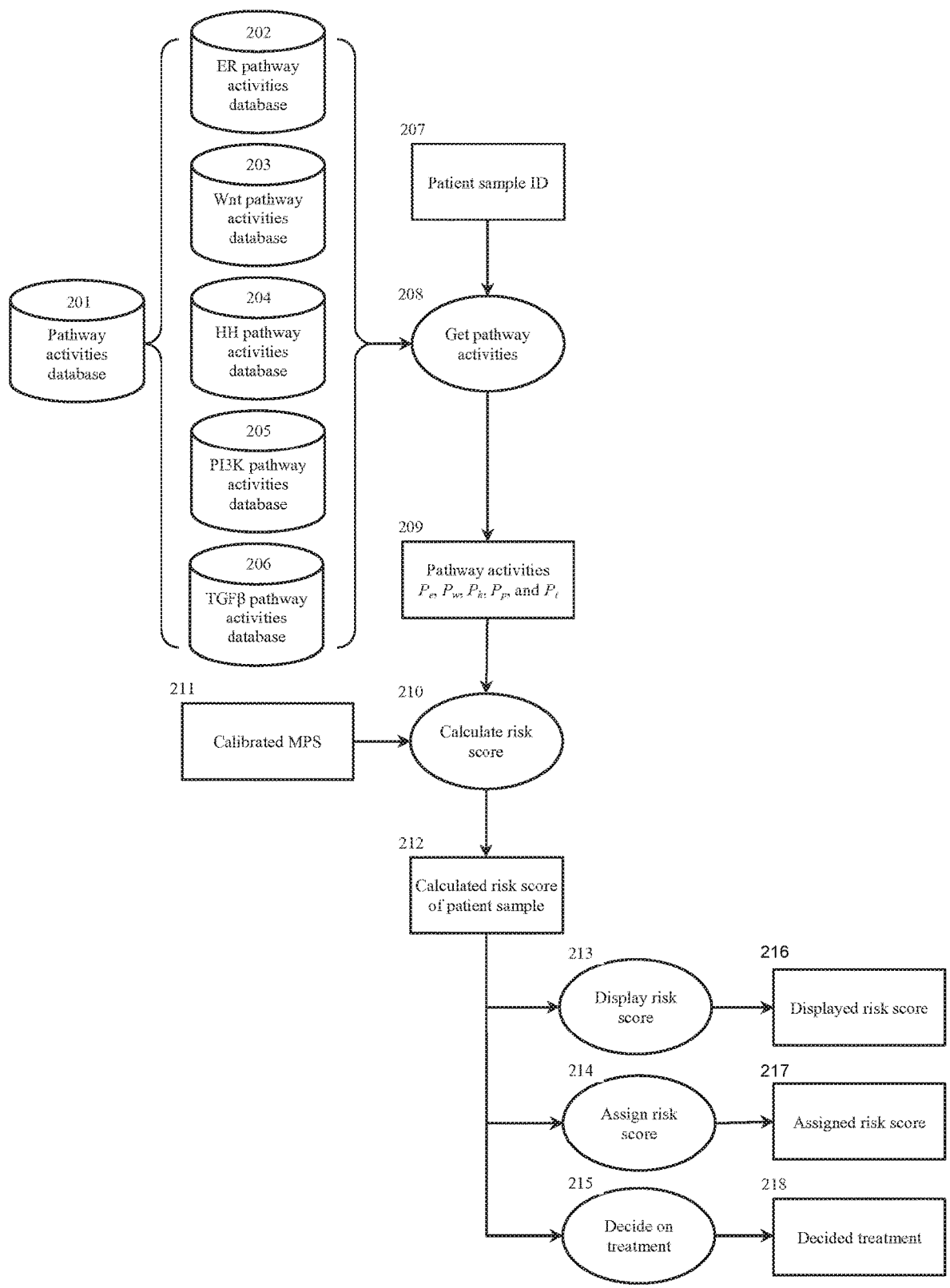
FIG. 22 is a non-limiting exemplary flow chart for calculating a risk score from a calibrated Multi-Pathway Score (MPS) model.

A non-limiting exemplary flow chart for calculating a risk score from a calibrated NIPS model is shown in FIG. 22. As an initial step, relevant pathway activities calculated using calibrated pathway models are retrieved from a pathway activities database (201). The pathway activities database contains TGF-β pathway activities (206) and the pathway activities for at least one additional pathway. For example, the pathway activities database contains ER pathway activities (202), Wnt pathway activities (203). HH pathway activities (204), PI3K pathway activities (205), and TGF- pathway activities (206). The patients sample is then identified (207) and initial pathway activities are collected from the sample and database as either a measurement of transcription factors or gene expression levels for the relevant pathways (208). Total activity levels of each of the relevant pathways are then calculated (209) with an output of $P_e$, $P_w$, $P_h$, $P_p$, and $P_t$. These activities are then converted to a risk score (210) using a calibrated NIPS model (211). This initial risk score can be further adjusted with other relevant data to produce a final risk score for the patient (212), which can then be used to display (213), assign (214), or decide on a treatment (215) producing the outcomes of a displayed risk score (216), an assigned risk score (217), or a decided treatment (218) respectively.

The calculating of the activity of the cellular signaling pathways in the subject may be performed, for example, by (i) evaluating at least a portion of a probabilistic model, for example a Bayesian network, representing the cellular signaling pathways for a set of inputs including at least the expression levels of the one or more target gene(s) of the cellular signaling pathways measured in a sample of the subject, (ii) estimating a level in the subject of at least one transcription factor (TF) element, the at least one TF element controlling transcription of the one or more target gene(s) of the cellular signaling pathways, the estimating being based at least in part on conditional probabilities relating the at least one TF element and the expression levels of the one or more target gene(s) of the cellular signaling pathway measured in the sample of the subject, and (iii) calculating the activity of the cellular signaling pathways based on the estimated level of the transcription factor in the sample of the subject. This is described in detail in the published international patent application WO 2013/011479 A2 ("Assessment of cellular signaling pathway activity using probabilistic modeling of target gene expression"), the contents of which are herewith incorporated in their entirety.

In an exemplary alternative, the calculating of the activity of one or more of the cellular signaling pathways in the subject may be performed by, for example, (i) determining a level of a transcription factor (TF) element in the sample of the subject, the TF element controlling transcription of the one or more target gene(s) of the cellular signaling pathway, the determining being based at least in part on evaluating a mathematical model relating expression levels of the one or more target gene(s) of the cellular signaling pathway to the level of the TF element, the model being based at least in part on one or more linear combination(s) of expression levels of the one or more target gene(s), and (ii) calculating the activity of the cellular signaling pathway in the subject based on the determined level of the TF element in the sample of the subject. This is described in detail in the published international patent application WO 2014/102668 A2 ("Assessment of cellular signaling pathway activity using linear combination(s) of target gene expressions").

One embodiment provides a method wherein the cellular signaling pathways comprise the PI3K pathway and/or the Wnt pathway and/or the ER pathway and/or the HH pathway, and wherein the risk score is defined such that the indicated risk that the subject will experience the clinical event within the certain period of time monotonically increases with an increasing inferred activity of the PI3K pathway and/or an increasing inferred activity of the Wnt pathway and/or an increasing inferred activity of the HH pathway and/or monotonically decreases with an increasing inferred activity of the ER pathway.

In one embodiment, a method is provided wherein the risk score is defined such that the indicated risk that the subject will experience the clinical event within the certain period of time monotonically increases with an increasing inferred activity of the TGF-β pathway.

In one embodiment, the combination of the inferred activities comprises a sum that includes the term $w_t \cdot P_t$ and one or more of the terms $w_p \cdot P_p$, $w_w \cdot P_w$, $w_e \cdot P_e$, and $w_h \cdot P_h$, wherein $P_t$, $P_p$, $P_w$, $P_e$, and $P_h$ denote the inferred activity of the TGF-β pathway, the PI3K pathway, the Wnt pathway, the ER pathway, and the HH pathway, respectively, $w_t$, $w_p$, $w_w$, and $w_h$ are positive constant weighting coefficients, $w$ is a negative constant weighting coefficient, and the indicated risk that the subject will experience the clinical event within the certain period of time monotonically increases with an increasing value of the sum.

In certain embodiment, the constant weighting coefficients $w_t$, $w_p$, $w_w$, $w_e$, and $w_h$, are or have each been determined based on the value of the Cox's coefficient resulting from fitting a Cox proportional hazard model for the respective cellular signaling pathway to clinical data. For example, the sign of the coefficient estimate indicates whether the pathway activity is either protective for the clinical event in case of a negative coefficient or predicts a poorer or worse prognosis in case of a positive coefficient. The modulus of the coefficient indicates the strength of the risk score with respect to prognosis.

In one embodiment, the clinical event is cancer metastasis and $w_t$ is a positive constant weighting coefficient, $w_p$, $w_w$ and $w_h$, are non-negative constant weighting coefficients, and $w_e$ is a non-positive constant weighting coefficient. With these coefficients the MPS show the indicated risk that the subject will experience the clinical event within the certain period of time monotonically increases with an increasing value of the sum.

Transcription Factor Elements

Each of the TGF-β pathway, the PI3K pathway, the Wnt pathway, the ER pathway, and the HH pathway is defined as the cellular signaling pathway that ultimately leads to transcriptional activity of the transcription factor (In complexes associated with the pathway. These consist of, as appropriate, at least a dimer of the TGF-β members (SMAD1, SMAD2, SMAD3, SMAD5 and SMAD8 with SMAD4) or a trimer (two proteins from SMAD1. SMAD2, SMAD3, SMAD5 and SMAD8 with SMAD4), a FOXO family member, β-catenin/TCF4, the ERα dimer, or a GLI family member, respectively.

The present disclosure concentrates on the TGF-β pathway and the SMAD TF family, the activity of which is substantially correlated with the activity of the TGF-β pathway, i.e., the activity of the SMAD TF complex is substantially correlated with the activity of the TGF-β pathway, whereas the inactivity of the SMAD TF complex is substantially correlated with the inactivity of the PI3K pathway.

Figure 1:
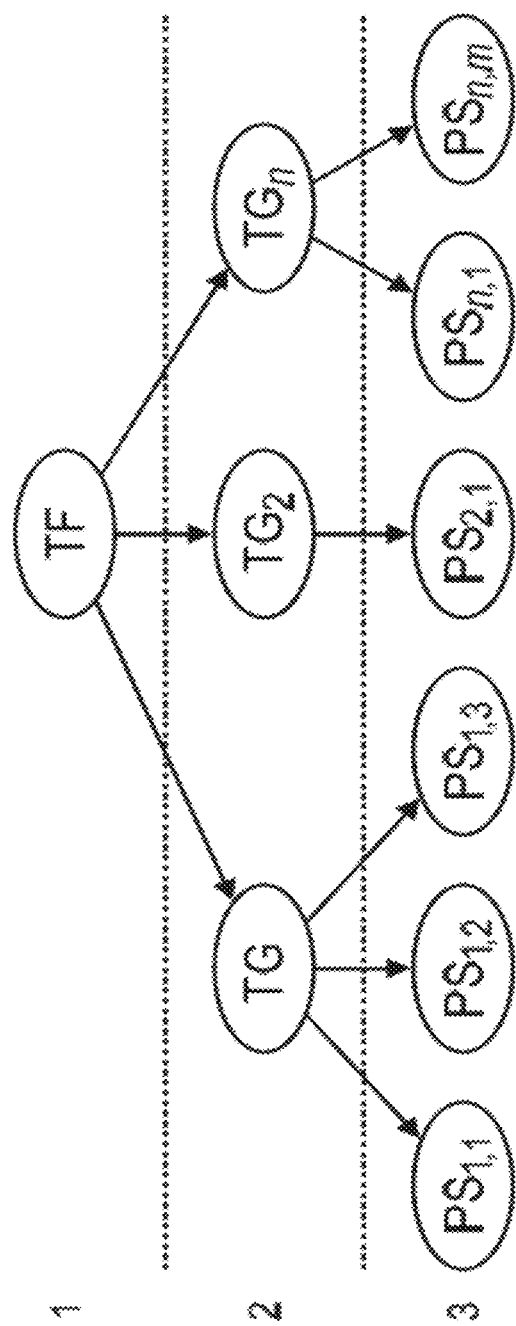
FIG. 1 shows schematically and exemplarily a mathematical model, herein, a Bayesian network model, used to model the transcriptional program of the TGF-β pathway, the PI3K pathway, the Wnt pathway, the ER pathway, and the HH pathway, respectively.

As a non-limiting generalized example. FIG. 1 provides an exemplary flow diagram used to determine activity level of cellular signaling pathways based on a computer implemented mathematical model constructed of three layers of nodes: (a) a transcription factor (TF) element (for example, but not limited to being, discretized into the states "absent" and "present" or as a continuous observable) in a first layer 1; (b) target gene(s) $TG_1$, $TG_2$, $TG_n$ (for example, but not limited to being, discretized into the states "down" and "up" or as a continuous observable) in a second layer 2, and; (c) measurement nodes linked to the expression levels of the target gene(s) in a third layer 3. The expression levels of the target genes can be determined by, for example, but not limited to, microarray probesets $PS_{1,1}$, $PS_{1,2}$, $PS_{1,3}$, $PS_{2,1}$, $PS_{n,1}$, $PS_{n,m}$ (for example, but limited to being, discretized into the states "low" and "high" or as a continuous observable), but could also be any other gene expression measurements such as, for example, RNAseq or RT-qPCR. The expression of the target genes depends on the activation of the respective transcription factor element, and the measured intensities of the selected proboscis depend in turn on the expression of the respective target genes. The calibrated model is used to calculate pathway activities by first determining probeset intensities, i.e., the expression level of the target genes, and calculating backwards in the model what the probability is that the transcription factor element must be present.

Kits for Calculating TGF-β, PI3K, Wnt, ER, and/or HH Signaling Pathway Activity

In some embodiments, the present disclosure utilizes kits comprising one or more components for determining or measuring target gene expression levels in a sample, for example, primer and probe sets for the analyses of the expression levels of unique sets of target genes (See Target Gene discussion above). Particularly suitable oligo sequences for use as primers and probes for inclusion in a kit are described in the following text passages and, for example, Tables 25, 26, 27, 28, and 29.

Also contemplated herein is a kit comprising one or more components for measuring a set of unique target genes as described further below.

In one non-limiting embodiment, the kit includes one or more components for measuring the expression levels of:

one or more, two or more, or at least three, target genes of the TGF-β pathway selected from the group consisting of: ANGPTL4, CDC42EP3, CDKN1A, CDKN2B, CTGF, GADD45A, GADD45B, HMGA2, ID1, IL11, INPP5D, JUNB, MMP2, MMP9, NKX2-5, OVOL1, PDGFB, PTHLH, SERPINE1, SGK1, SKIL, SMAD4, SMAD5, SMAD6, SMAD7, SNAI1, SNAI2, TIMP1, and VEGFA, or from the group consisting of: ANGPTL4, CDC42EP3, CDKN1A, CTGF, GADD45A, GADD45B, HMGA2, ID1, SERPINE1, JUNB, PDGFB, PTHLH, SGK1, SKIL, SMAD4, SMAD5, SMAD6, SMAD7, SNAI2, and VEGFA, or from the group consisting of: ANGPTL4, CDC42EP3, CDKN1A, CTGF, GADD45B, ID1, SERPINE1, JUNB, VEGFA, SKIL, SMAD7, and SNAI2, or from the group consisting of: ANGPTL4, CDC42EP3, ID1, SERPINE1, JUNB, SKIL, and SMAD7, and/or one or more, two or more, or at least three, target gene(s) of the PI3K pathway selected from the group consisting of: AG-RP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MX1.1, NOS3, PCK1, POMC, PPARGC1A, PRDX3, RBL2. SOD2, and TNFSF10, and/or one or more, two or more, or at least three, target gene(s) of the Wnt pathway selected from the group consisting of: KIAA1199 (CEMIP), AKIN2, CD44, RNF43, MYC, TBX3, TDGF1, SOX9, ASCL2, IL8 (CXCL8), SP5, ZNRF3, EPHB2, LGR5, EPHB3, KLF6, CCND1, DEFA6, and FZD7, and/or one or more, two or more, or at least three, target gene(s) of the ER pathway selected from the group consisting of: GREB1, PGR, XBP1, CA12, SOD1, CTSD, IGFBP4, TFF1, SGK3, NRIP1, CELSR2, WISP2, AP1B1 PDZK1, ERBB2, and ESR1, and/or one or more, two or more, or at least three, target gene(s) of the HH pathway selected from the group consisting of: GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1.

In an additional non-limiting embodiment, the kit includes one or more components for measuring the expression levels of:

one or more, two or more, or at least three, target genes of the TGF-β pathway selected from the group consisting of ANGPTL4, CDC42EP3, CDKN1A, CTGF, GADD45B, ID1, SERPINE1, JUNB, VEGFA, SKIL, SMAD7, and SNAI2, and/or one or more, two or more, or at least three, target gene(s) of the PI3K pathway selected from the group consisting of BCL2L11, BCL6, BNIP3, BTG1, CCNG2, CDKN1B, FBXO32, GADD45A, INSR, MXI1, SOD2, and TNFSF10, and/or one or more, two or more, or at least three, target gene(s) of the Wnt pathway selected from the group consisting of: KIAA1199 (CEMIP), AXIN2, CD44, RNF43, MYC, TDGF1, SOX9, IL8 (CXCL8), ZNRF3, LGR5, EPHB3, and DEFA6, and/or one or more, two or more, or at least three, target gene(s) of the ER pathway selected from the group consisting of: GREB1, PGR, XBP1, CA12, IGFBP4, TIFF1, SGK3, NRIP1, CELSR2, PDZK1, ERBB2, and ESR1, and/or one or more, two or more, or at least three, target genet(s) of the HH pathway selected from the group consisting of: GLI1, PTCH1, PTCH2, IGFBP6, CCND2, FST, CFLAR, RAB34, S100A9, S100A7, MYCN, and GLI3.

In one non-limiting embodiment, the kit includes one or more components for measuring the expression levels of one or more, two or more, or at least three, TGF-β target genes selected from ANGPTL4, and at least two of CDC42EP3, ID1, IL11, JUNB, SKIL, or SMAD7. In one embodiment, the at least three TGF-β target genes are CDC42EP3, and at least two of ANGPTL4, ID1, IL11, JUNB, SKIL, or SMAD7. In one embodiment, the at least three TGF-β target genes are ANGPTL4, and at least two of CDC42EP3. ID1, SERPINE1, JUNB, SKIL, or SMAD7. In one embodiment, the at least three TGF-β target genes are CDC42EP3, and at least two of ANGPTL4, ID1, SERPINE1, JUNB, SKIL, or SMAD7. In one embodiment, the at least three TGF-β target genes are ANGPTL4, CDC42EP3, and at least one of ID1, IL11, JUNB, SKIL, or SMAD7. In one embodiment, the at least three TGF-β target genes are ANGPTL4, CDC42EP3, and at least one of ID1, SERPINE1, JUNB, SKIL, or SMAD7. In one embodiment, the kit includes one or more components for measuring the expression levels of the TGF-β target genes ANGPTL4, CDC42EP3, ID1, IL11, JUNB, SKIL, and SMAD7. In one embodiment, the kit includes one or more components for measuring the expression levels of the TGF-β target genes ANGPTL4, CDC42EP3, ID1, SERPINE1, JUNB, SKIL, and SMAD7.

In one embodiment, the kit includes one or more components for measuring the expression levels of at least three TGF-β target genes, wherein the TGF-β target genes are selected from ANGPTL4, CDC42EP3, ID1, SERPINE1, JUNB, SKIL, or SMAD7, and the one or more components are selected from the primers and probes listed in Table 25.

In one non-limiting embodiment, the kit includes one or more components for measuring the expression levels of one or more, two or more, or at least three, TGF-β target genes selected from the group consisting of ANGPTL4, CDC42EP3, CDKN1A, CDKN2B, CTGF, GADD45A, GADD45B, HMGA2, ID1, IL11, INPP5D, JUNB, MMP2, MMP9, NKX2-5, OVOL1, PDGFB, PTHLH, SERPINE1, SGK1, SKIL, SMAD4, SMAD5, SMAD6, SMAD7, SNAI1, SNAI2, TIMP1, and VEGFA. In another embodiment, the TGF-β target genes are selected from the group consisting of: ANGPTL4, CDC42EP3, CDKN1A, CTGF, GADD45B, ID1, SERPINE1, JUNB, VEGFA, SKIL, SMAD7, and SNAI2. In one embodiment, the one or more components are selected from the primers and probes listed in Table 25.

In one non-limiting embodiment, the kit includes one or more components for measuring the expression levels of one or more, two or more, or at least three, PI3K target genes selected from the group consisting of: AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10. In another embodiment, the PI3K target genes are selected from the group consisting of BCL2L11, BCL6, BNIP3, BTG1, CCNG2, CDKN1B, FBXO32, GADD45A, INSR, MXI1, SOD2, and TNFSF10. In one embodiment, the one or more components are selected from the primers and probes listed in Table 26.

In one non-limiting embodiment, the kit includes one or more components for measuring the expression levels of one or more, two or more, or at least three, Wnt target genes selected from the group consisting of: KIAA1199 (CEMIP), AXIN2, CD44, RNF43, MYC, TBX3, TDGF1, SOX9, ASCL2, IL8 (CXCL8), SP5, ZNRF3, EPHB2, LGR5, EPHB3, KLF6, CCND1, DEFA6, and FZD7. In another embodiment, the Wnt target genes are selected from the group consisting of: KIAA1199 (CEMIP), AXIN2, CD44, RNF43, MYC, TDGF1, SOX9, IL8 (CXCL8), ZNRF3, LGR5, EPHB3, and DEFA6. In one embodiment, the one or more components are selected from the primers and probes listed in Table 27.

In one non-limiting embodiment, the kit includes one or more components for measuring the expression levels of one or more, two or more, or at least three, ER target genes selected from the group consisting of: GREB1, PGR, XBP1, CA12, SOD1, CTSD, IGFBP4, TFF1, SGK3, NRIP1, CELSR2, WISP2, AP1B1, PDZK1, ERBB2, and ESR1. In another embodiment, the ER target genes are selected from the group consisting of: GREB1, PGR, XBP1, CA12, IGFBP4, TFF1, SGK3, NRIP1, CELSR2, PDZK1, ERBB2, and ESR1. In one embodiment, the one or more components are selected from the primers and probes listed in Table 28.

In one non-limiting embodiment, the kit includes one or more components for measuring the expression levels of one or more, two or more, or at least three, HH target genes selected from the group consisting of: GM, PTCH1, PTCH2, IGFBP6, SPP1, CCND2, FST, CFLAR, TSC22D1, RAB34, S100A9, S100A7, MYCN, FOXM1, GLI3, TCEA2, FYN, and CTSL1. In another embodiment, the HH target genes are selected from the group consisting of: GLI1, PTCH1, PTCH2, IGFBP6, CCND2, FST, CFLAR, RAB34, S100A9, S100A7, MYCN, and GLI3. In one embodiment, the one or more components are selected from the primers and probes listed in Table 29.

In one embodiment, the kit comprises an apparatus comprising a digital processor. In another embodiment, the kit comprises a non-transitory storage medium storing instructions that are executable by a digital processing device. In yet another embodiment, the kit comprises a computer program comprising program code means for causing a digital processing device to perform the methods described herein.

In an additional embodiment, the kit contains one or more components that are selected from the group consisting of: a DNA array chip, an oligonucleotide array chip, a protein array chip, an antibody, a plurality of probes, RNA sequencing and a set of primers. In one embodiment, the kit contains a plurality of probes. In one embodiment, the kit contains a set of primers. In one embodiment, the kit contains a 6, 12, 24, 48, 96, or 384-well PCR plate. In one embodiment, the kit includes a 96 well PCR plate. In one embodiment, the kit includes a 384 well PCR plate.

In one embodiment, the kit further includes a non-transitory storage medium containing instructions that are executable by a digital processing device to perform a method according to the present disclosure as described herein. In one embodiment, the kit includes an identification code that provides access to a server or computer network for analyzing the activity level of the TGF-β, PI3K, Wnt, ER, and cellular signaling pathways based on the expression levels of the target genes and the methods described herein.

In one embodiment, provided herein is a kit for identifying a subject at risk of experiencing a clinical event associated with a disease within a defined period of time comprising: a) one or more components capable of measuring the expression levels of a set of at least three TGF-β cellular signaling target genes, wherein the at least three TGF-β target genes are selected from ANGPTL4, CDC42EP3, CDKN1A, CDKN2B, CTGF, GADD45A, GADD45B, HMGA2, ID1, IL11, SERPINE1, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA; b) one or more components capable of measuring the expression levels of a set of at least one other cellular signaling pathway target genes, Wherein the other cellular signaling pathway target genes are selected from PI3K cellular signaling pathway target genes, Wnt cellular signaling pathway target genes, ER cellular signaling pathway target genes, and HH cellular signaling pathway target genes; and, c) a non-transitory computer readable storage medium having computer readable program code embodied therewith, the computer readable program code executable by at least one processor.

In one embodiment, provided herein is a kit comprising one or more components (e.g., primers and probes) capable of measuring the expression levels of: a) TGF-β cellular signaling target genes ANGPTL4, CDC42EP3, ID1, SERPINE, JUNB, SKIL, SMAD7, CDKN1A, CTGF, GADD45B, VEGFA, and SNAI2; h) PI3K signaling target genes FBXO32, BCL2L11, SOD2, TNFSF10, BCL6, BTG1, CCNG2, CDKN1B, BNIP3, GADD45A, INSR, and MXI1; c) Wnt target genes AXIN2, CD44, LGR5, CEMIP, MYC, CXCL8, SOX9, EPHB3, RNF43, TDGF1, ZNRF3, and DEFA6; d) ER target genes CDH26, SGK3, PGR, GREB1, CA12, XBP1, CELSR2, WISP2, DSCAM, ERBB2, CTSD, TFF1, and NRIP; and, e) HH target genes TFF1, GREB1, PGR, SGK3, PDZK1, IGFBP4, CA12, XBP1, ERBB2, ESR1, and CELSR2.

In another embodiment, provided herein is a kit comprising one or more components (e.g., primers and probes) capable of measuring the expression levels of: a) at least three TGF-β cellular signaling target genes selected from ANGPTL4, CDC42EP3, ID1, SERPINE, JUNB, SKIL, SMAD7, CDKN1A, CTGF, GADD45B, VEGFA, and SNAI2; h) at least three PI3K signaling target genes selected from FBXO32, BCL2L11, SOD2, TNFSF10, BCL6, BTG1, CCNG2, CDKN1B, BNIP3, GADD45A, INSR, and MXI1; c) at least three Wnt target genes selected from AXIN2, CD44, LGR5, CEMIP, MYC, CXCL8, SOX9, EPHB3, RNF43, TDGF1, ZNRF3, and DEFA6; d) at least three ER target genes selected from CDH26, SGK3, PGR, GREB1, CA12, XBP1, CELSR2, WISP2, DSCAM, ERBB2, CTSD, TFF1, and NRIP; and, e) at least three HH target genes selected from TFF1, GREB1, PGR, SGK3, PDZK1, IGFBP4, NRIP1, CA12, XBP1, ERBB2, ESR1, and CELSR2.

In one embodiment, provided herein is a kit for measuring the expression levels of cellular signaling target genes in a sample isolated from a subject comprising: a) a set of polymerase chain reaction primers directed to at least three TGF-β cellular signaling pathway target genes from a sample isolated from a subject; b) a set of probes directed to the at least three TGF-β cellular signaling pathway target genes; c) a set of polymerase chain reaction primers directed to a set of at least three target genes from at least one other cellular signaling pathways, wherein the other cellular signaling pathway genes are selected from PI3K cellular signaling pathway target genes, Wnt cellular signaling pathway target genes, ER cellular signaling pathway target genes, and HH cellular signaling pathway target genes; and, d) a set of probes directed to the at least one other cellular signaling pathway target genes.

Target Gene Expression Level Determination Procedure

Figure 23:
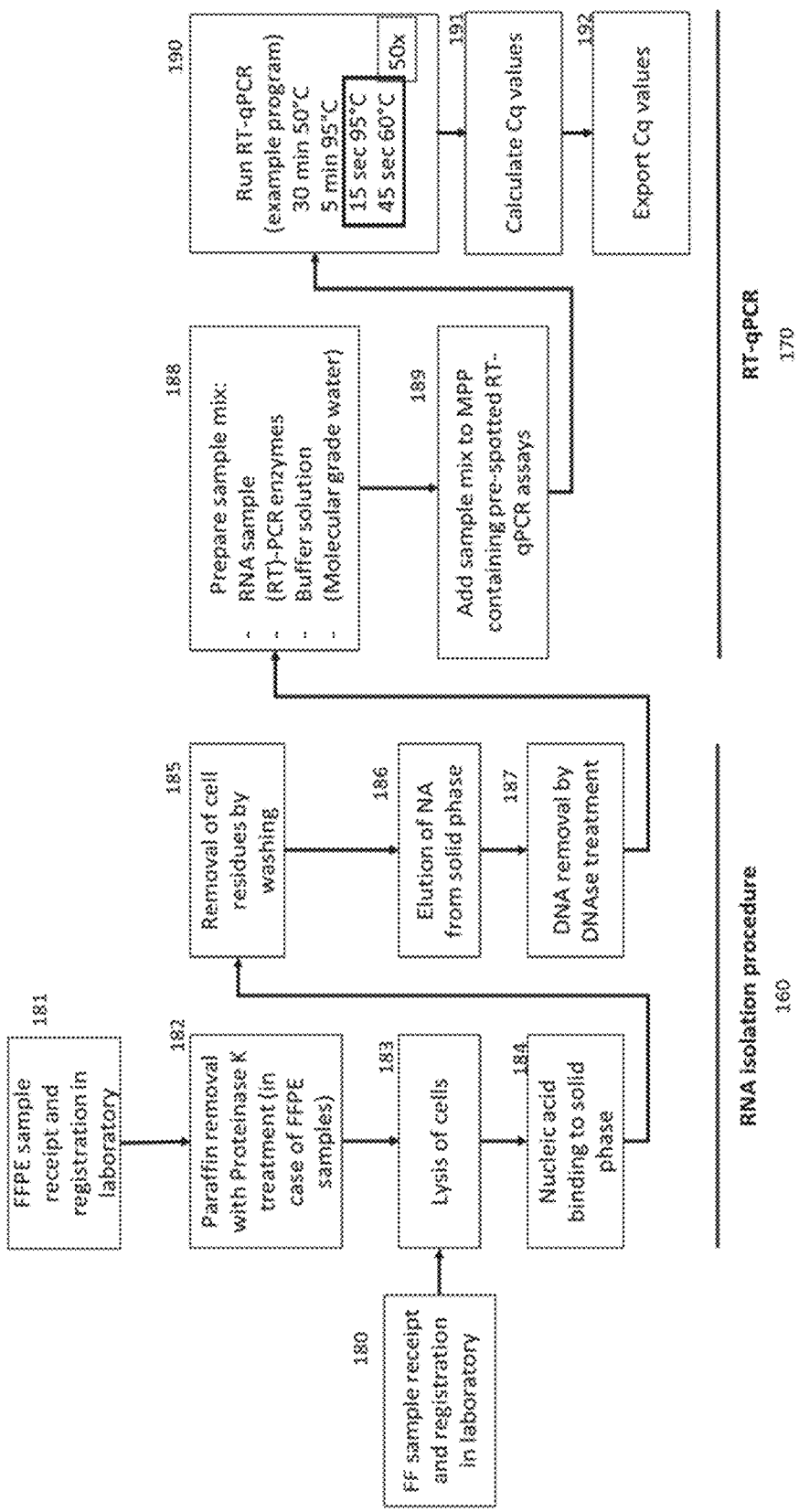
FIG. 23 shows a flow chart for determining Cq values from RT-qPCR analysis of the target genes of the TGF-β cellular signaling pathway.

A non-limiting exemplary flow chart for deriving target gene expression levels from a sample isolated from a subject is shown in FIG. 23, which shows an RNA isolation procedure (160) and an RT-qPCR (170). In one exemplary embodiment, samples are received and registered in a laboratory. Samples can include, for example, Formalin-Fixed, Paraffin-Embedded (FFPE) samples (181) or fresh frozen (FF) samples (180). FF samples can be directly lysed (183). For FFPE samples, the paraffin can be removed with a heated incubation step upon addition of Proteinase K (182). Cells are then lysed (183), which destroys the cell and nuclear membranes which makes the nucleic acid (NA) available for further processing. The nucleic acid is bound to a solid phase (184) which could for example, be beads or a filter. The nucleic acid is then washed with washing buffers to remove all the cell debris which is present after lysis (185). The clean nucleic acid is then detached from the solid phase with an elution buffer (186). The DNA is removed by DNAse treatment to ensure that only RNA is present in the sample (187). The nucleic acid sample can then be directly used in the RT-qPCR sample mix (188). The RT-qPCR sample mixes contains the RNA sample, the RT enzyme to prepare cDNA from the RNA sample and a PCR enzyme to amplify the cDNA, a buffer solution to ensure functioning of the enzymes and can potentially contain molecular grade water to set a fixed volume of concentration. The sample mix can then be added to a multiwell plate (i.e., 96 well or 384 well plate) which contains dried RT-qPCR assays (189). The RT-qPCR can then be run in a PCR machine according to a specified protocol (190). An example PCR protocol includes i) 30 minutes at 50° C.; ii) 5 minutes at 95° C.; iii) 15 seconds at 95° C.; iv) 45 seconds at 60° C.; v) 50 cycles repeating steps iii and iv. The Cq values are then determined with the raw data by using the second derivative method (191). The Cq values are exported for analysis (192).

Computer Programs, Computer Implemented Methods, and Clinical Decision Support (CDS) Systems As contemplated herein, the calculation of cellular pathway signaling activity in the sample is performed on a computerized device having a processor capable of executing a readable program code for calculating the cellular signaling pathway activity in the sample according to the methods described above.

In accordance with another disclosed aspect, an apparatus comprises a digital processor configured to perform a method according to the disclosure as described herein.

In accordance with another disclosed aspect, a non-transitory storage medium stores instructions that are executable by a digital processing device to perform a method according to the disclosure as described herein. The non-transitory storage medium may be a computer-readable storage medium, such as a hard drive or other magnetic storage medium, an optical disk or other optical storage medium, a random access memory (RAM), read only memory (ROM), flash memory, or other electronic storage medium, a network server, or so forth. The digital processing device may be a handheld device (e.g., a personal data assistant or smartphone), a notebook computer, a desktop computer, a tablet computer or device, a remote network server, or so forth.

In accordance with another disclosed aspect, an apparatus comprises a digital processor configured to perform a method according to the present disclosure as described herein.

In accordance with another disclosed aspect, a computer program comprises program code means for causing a digital processing device to perform a method according to the disclosure as described herein. The digital processing device may be a handheld device (e.g., a personal data assistant or smartphone), a notebook computer, a desktop computer, a tablet computer or device, a remote network server, or so forth.

In one embodiment, a computer program or system is provided for predicting the activity status of a transcription factor element in a human cancer sample that includes a means for receiving data corresponding to the expression level of one or more target genes in a sample from a host. In some embodiments, a means for receiving data can include, for example, a processor, a central processing unit, a circuit, a computer, or the data can be received through a website.

In one embodiment, a computer program or system is provided for predicting the activity status of a transcription factor element in a human cancer sample that includes a means for displaying the pathway signaling status in a sample from a host. In some embodiments, a means for displaying can include a computer monitor, a visual display, a paper print out, a liquid crystal display (LCD), a cathode ray tube (CRT), a graphical keyboard, a character recognizer, a plasma display, an organic light-emitting diode (OLED) display, or a light emitting diode (LED) display, or a physical print out.

In accordance with another disclosed aspect, a signal represents a risk score that indicates a risk that a clinical event will occur within a certain period of time, wherein the risk score resulted from performing a method according to the disclosure as described herein. The signal may be an analog signal or it may be a digital signal.

Figure 19:
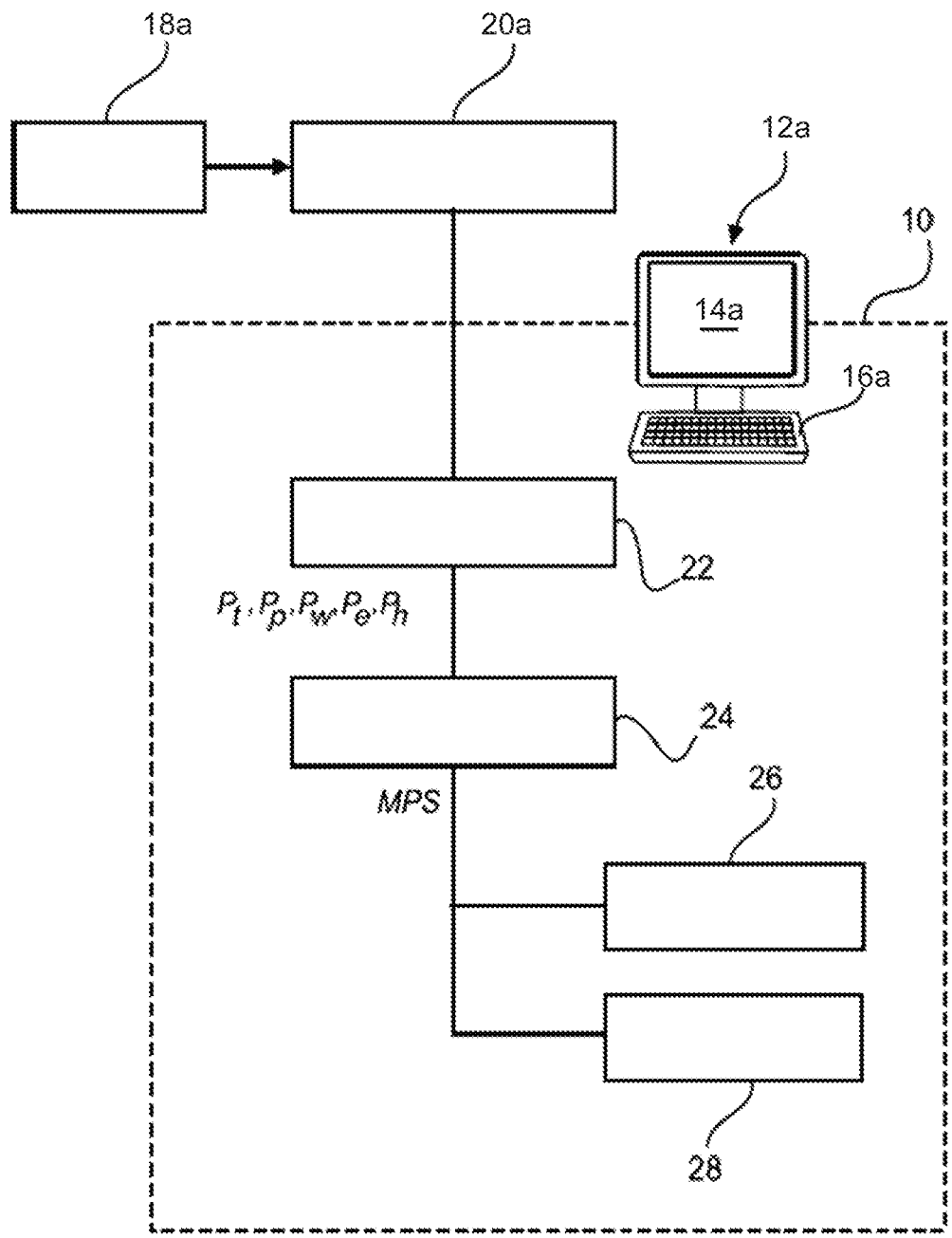
FIG. 19 diagrammatically shows a clinical decision support (CDS) system configured to determine a risk score that indicates a risk that a subject will experience a clinical event within a certain period of time, as disclosed herein.

One advantage resides in a clinical decision support (CDS) system as illustrated in FIG. 19 described in more detail in Example 3 below, that is adapted to provide clinical recommendations, e.g., by deciding a treatment for a subject, based on an analysis of two or more cellular signaling pathways, for example, using a probabilistic or another mathematical model of the TGF-β pathway, the PI3K pathway, the Wnt pathway, the ER pathway, and the HH pathway, in particular, based on a risk that the subject will experience a clinical event, e.g., cancer, in particular, breast cancer, within a certain period of time, as indicated by a risk score that is based at least in part on a combination of inferred activities of the cellular signaling pathways.

Another advantage resides in a CDS system that is adapted to assign a subject to at least one of a plurality of risk groups associated with different risks that the subject will experience a clinical event, e.g., cancer, in particular, breast cancer, within a certain period of time, as indicated by a risk score that is based at least in part on a combination of inferred activities of two or more cellular signaling pathways.

Another advantage resides in combining a risk score that indicates a risk that a subject will experience a clinical event within a certain period of time and that is based at least in part on a combination of inferred activities of two or more cellular signaling pathways with one or more additional risk scores obtained from one or more additional prognostic tests.

Diseases, Disorders, and Methods of Treatment

As contemplated herein, the methods and apparatuses of the present disclosure can be utilized to assess TGF-β, PI3K, Wnt, ER, and/or HH cellular signaling pathway activity in a subject, for example a subject suspected of having, or having, a disease or disorder wherein the status of one of the signaling pathwaies is probative, either wholly or partially, of disease presence or progression. In one embodiment, provided herein is a method of treating a subject comprising receiving information regarding the activity status of a TGF-β, PI3K, Wnt, ER, and/or HH cellular signaling pathways derived from a sample isolated from the subject using the methods described herein and administering to the subject an inhibitor of TGF-β, PI3K, Wnt, ER, and/or HH if the information regarding the level of the cellular signaling pathways is indicative of an active TGF-β, PI3K, Wnt, ER, and/or HH signaling pathway.

TGF-β inhibitors are known and include, but are not limited to, Terameprocol, Fresolimumab, Sotatercept, Galwiisertib, SB431542, LY2109761, LDN-193189, SB525334, SB505124, GW788388, LY364947, RepSox, LDN-193189 HCl, K02288, LDN-214117, SD-208, EW-7197, ML347, LDN-212854, DMH1, Pirfenidone, Hesperetin, Trabedersen, Lerdelimumab, Metelimumab, trx-SARA, ID11, Ki26894, or SB-431542.

PI3K inhibitors that may be used in the present disclosure are well known. Examples of PI3K inhibitors include but are not limited to Wortmarmin, demethoxyviridin, perifosine, idelalisb, Pictilisib, Palomid 529, ZSTK474, PWT33597, CUDC-907, and AEZS-136, duvelisib, GS-9820, BKM120, GDC-0032 (Taselisib) (2-[4-[2-(2-Isopropyl-5-methyl-1,2,4-triazol-3-yl)-5,6-dihydroimidazo[1,2-d][1,4]benzoxazepin-9-yl]pyrazol-1-yl]-2-methylpropanamide), MLN-1117 ((2R)-1-Phenoxy-2-butanyl hydrogen (S)-methylphosphonate; or Methyl(oxo) {[(2R)-1-phenoxy-2-butanyl]

oxy}phosphonium)), BYL-719 ((2S)-N1-[4-Methyl-5-[2-(2,2,2-trifluoro-1,1-dimethylethyl)-4-pyridinyl-]2-thiazolyl]-1,2-pyrrolidinedicarboxamide), GSK2126458 (2,4-Difluoro-N-{2-(methyloxy)-5-[4-(4-pyridazinyl)-6-quinolinyl]-3-pyridinyl}benzenesulfonamide) (omipalisib), TGX-221 ((±)-7-Methyl-2-(morpholin-4-yl)-9-(1-phenylaminoethyl)-pyrido[1,2-a]-pyrimidin-4-one), GSK2636771 (2-Methyl-1-(2-methyl-3-(trifluoromethyl)benzyl)-6-morpholino-1H-benzo[d]imidazole-4-carboxylic acid dihydrochloride), KIN-193 ((R)-2-((1-(7-methyl-2-morpholino-4-oxo-4H-pyrido[1,2-a]pyrimidin-9-yl)ethyl)amino)benzoic acid), TGR-1202/RP5264, GS-9820 ((S)-1-(4-((2-(2-aminopyrimidin-5-yl)-7-methyl-4-mohydroxypropan-1-one), GS-1101 (5-fluoro-3-phenyl-2-([S)]-1-[9H-purin-6-ylamino]-propyl)-3H-quinazolin-4-one), AMG-319, GSK-2269557, SAR245409 (N-(4-(N-(3-((3,5-dimethoxyphenyl)amino)quinoxalin-2-yl)sulfamoyl)phenyl)-3-methoxy-4 methylbenzamide), BAY80-6946 (2-amino-N-(7-methoxy-8-(3-morpholinopropoxy)-2,3-dihydroimidazo[1,2-c]quinaz), AS 252424 (5-[1-[5-(4-Fluoro-2-hydroxy-phenyl)-furan-2-yl]-meth-(Z)-ylidene]-thiazolidine-2,4-dione), CZ 24832 (5-(2-amino-8-fluoro-[1,2,4]triazolo[1,5-a]pyridin-6-yl)-N-tert-butylpyridine-3-sulfonamide), Buparlisib (5-[2,6-Di(4-morpholinyl)-4-pyrimidinyl]-4-(trifluoromethyl)-2-pyridinainine), GDC-0941 (2-(1H-Indazol-4-yl)-6-[[4-(methylsulfonyl)-1-piperazinyl]methyl]-4-(4-morpholinyl) thieno[3,2-d]pyrimidine), GDC-0980 ((S)-1-(4-((2-(2-aminopyrimidin-5-yl)-7-methyl-4-morpholinothieno[3,2-d] pyrimidin-6 yl)methyl)piperazin-1-yl)-2-hydroxypropan-1-one (also known as RG7422)), SF1126 ((8S,14S,17S)-14-(carboxymethyl)-8-(3-guanidinopropyl)-17-(hydroxymethl)-3,6,9,12,15-pentaoxo-1-(4-(4-oxo-8-phenyl-4H-chromen-2-yl)morpholino-4-ium)-2-oxa-7,10,13,16-tetraazaoctadecan-18-oate), PF-05212384 (N-[4-[[4-(Dimethylamino)-1-piperidinyl]carbonyl]phenyl]-N'-[4-(4,6-di-4-morpholinyl-1,3,5-triazin-2-yl)phenyl]urea) (gedatolisib), LY3023414, BEZ235 (2-Methyl-2-{4-[3-methyl-2-oxo-8-(quinolin-3-yl)-2,3-dihydro-1H-imidazo[4,5-c]quinolin-1-yl]phenyl}propanenitrile) (dactolisib), XL-765 (N-(3-(N-3-(3,5-dimethoxyphenylamino)quinoxalin-2-yl)sulfamoyl)phenyl)-3-methoxy-4-methylbenzamide), and GSK1059615 (5-[[4-(4-Pyridinyl)-6-quinolinyl]methylene]-2,4-thiazolidenedione), PX886 ([(3aR,6E,9S,9aR,10R,11aS)-6-[[bis(prop-2-enyl)amino] methylidene]-5-hydroxy-9-(methoxymethyl)-9a,11a-dimethyl-1,4,7-trioxo-2,3,3a,9,10,11-hexahydroindeno[4,5h]isochromen-10-yl]acetate (also known as sonolisib)), LY294002, AZD8186, PF-4989216, pilaralisib, GNE-317, PI-3065, PI-103, NU7441 (KU-57788), HS 173, VS-5584 (SB2343), CZC24832, TG100-115, A66, YM201636, CAY10505, PIK-75, PIK-93, AS-605240, BGT226 (NVP-BGT226), AZD6482, voxtalisib, alpelisib, IC-87114, TGI100713, CH5132799, PKI-402, copanlisib (BAY 80-6946), XL 147, PIK-90, PIK-293, PIK-294, 3-MA (3-methyladenine), AS-252424, AS-604850, apitolisib (GDC-0980; RG7422), and the structures described in WO20141071109. Alternatively, inhibitors of the mTOR complex downstream of PI3K are valuable inhibitors of aberrant PI3K activity. Alternatively, inhibitors of the HER2 complex upstream of PI3K are valuable inhibitors of aberrant PI3K activity. Examples of HER2 inhibitors include but are not limited to trastuzumab, lapatinib, pertuzumab.

Endocrine therapy can be administered in breast cancers that are estrogen receptor positive. Endocrine therapy treatments that may be used in the present disclosure are well known. Endocrine therapy consists of administration of i) ovarian function suppressors, usually obtained using gonadotropin-releasing hormone agonists (GnRHa), ii) selective estrogen receptor modulators or down-regulators (SERMs or SARDs), or iii) aromatase inhibitors (AIs), or a combination thereof. Ovarian function suppressors include, for example, gonadotropin-releasing hormone agonists (GnRHa). Examples of gonadotropin-releasing hormone agonists (GnRHa) can include buserelin, deslorelin, gonadorelin, goserelin, histrelin, leuprorelin, nafarelin, and triptorelin. Selective estrogen receptor modulators (SERMs) include, for example, tamoxifen, toremifene, raloxifene, lasofoxifene, bazedoxifene, clomifene, ormeloxifene, ospemifene, afimoxifene, and arzoxifene. Selective estrogen receptor down-regulators (SERDs) include, for example, fulvestrant, SR16234, and ZK191703. Aromatase inhibitors include, for example, anastrozole, letrozole, vorozole exemestane, aminoglutethimide, testolactone, formestane, fadrozole, androstenedione, 4-hydroxyandrostenedione, 1,4,6-androstatrien-3,17-dione, or 4-androstene-3,6,17-trione. In one embodiment, the aromatase inhibitor is a non-steroidal aromatase inhibitor.

Wnt inhibitors are well known and include, but are not limited to, pyrvinium, IWR-1-endo, IWP-2, FH535, WIK14, IWP-L6, KY02111, LGK-974, Wnt-C59, XAV929, 3289-8625, FJ9, NSC 668036, PFK115-584, CGP049090, iCRT3, iCRT5, iCRT14, ICG-001, demethoxy curcumin, CCT036477, KY02111, PNU-74654, or PRI-724.

HH inhibitors are well known and include, but are not limited to, cyclopiamine, SANT1-SANT4, CUR-61414, HhAntag-691, GDC-0449, MK4101, IPI-926, BMS-833923, robotnikinin, itraconazole, Erivedge, Odomzo, Calcitriol, Cholecalciferol, IPI-906, RU-SKI 39, or KAAD-cyclopamine. NVP-LDE225, TAK-441, XL-139, LY2940680, NVP-LEQ506, Itraconazole, MRT-10, MRT-83, PF-04449913, GANT-61, GANT-58, HPI-1, HPI-3, or HPI-4.

In one embodiment, the disease or disorder is one of an auto-immune and other immune disorders, cancer, bronchial asthma, heart disease, diabetes, hereditary hemorrhagic telangiectasia, Marfan syndrome, Vascular Ehlers-Danlos syndrome, Loeys-Dietz syndrome, Parkinson's disease, Chronic kidney disease, Multiple Sclerosis, fibrotic diseases such as liver, lung, or kidney fibrosis, Dupuytren's disease, or Alzheimer's disease.

In a particular embodiment, the subject is suffering from, or suspected to have, a cancer, for example, but not limited to, a primary tumor or a metastatic tumor, a solid tumor, for example, melanoma, lung cancer (including lung adenocarcinoma, basal cell carcinoma, squamous cell carcinoma, large cell carcinoma, bronchioloalveolar carcinoma, bronchiogenic carcinoma, non-small-cell carcinoma, small cell carcinoma, mesothelioma); breast cancer (including ductal carcinoma, lobular carcinoma, inflammatory breast cancer, clear cell carcinoma, mucinous carcinoma, serosal cavities breast carcinoma); colorectal cancer (colon cancer, rectal cancer, colorectal adenocarcinoma); anal cancer; pancreatic cancer (including pancreatic adenocarcinoma, islet cell carcinoma, neuroendocrine tumors); prostate cancer; prostate adenocarcinoma; ovarian carcinoma (ovarian epithelial carcinoma or surface epithelial-stromal tumor including serous tumor, endometrioid tumor and mucinous cystadenocarcinoma, sex-cord-stromal tumor); liver and bile duct carcinoma (including hepatocellular carcinoma, cholangiocarcinoma, hemangioma); esophageal carcinoma (including esophageal adenocarcinoma and squamous cell carcinoma); oral and oropharyngeal squamous cell carcinoma; salivary gland adenoid cystic carcinoma; bladder cancer; bladder carcinoma; carcinoma of the uterus (including endometrial adenocarcinoma, ocular, uterine papillary serous carcinoma, uterine clear-cell carcinoma, uterine sarcomas and leiomyosarcomas, mixed mullerian tumors); glioma, glioblastoma, medulloblastoma, and other tumors of the brain; kidney cancers (including renal cell carcinoma, clear cell carcinoma, Wilm's tumor); cancer of the head and neck (including squamous cell carcinomas); cancer of the stomach (gastric cancers, stomach adenocarcinoma, gastrointestinal stromal tumor); testicular cancer; germ cell tumor; neuroendocrine tumor; cervical cancer; carcinoids of the gastrointestinal tract, breast, and other organs; signet ring cell carcinoma; mesenchymal tumors including sarcomas, fibrosarcomas, haemangioma, angiomatosis, haemangiopericytoma, pseudoangiomatous stromal hyperplasia, myofibroblastoma, fibromatosis, inflammatory myofibroblastic tumor, lipoma, angiolipoma, granular cell tumor, neurofibroma, schwannoma, angiosarcoma, liposarcoma, rhabdomyosarcoma, osteosarcoma, leiomyoma, leiomysarcoma, skin, including melanoma, cervical, retinoblastoma, head and neck cancer, pancreatic, brain, thyroid, testicular, renal, bladder, soft tissue, adenal gland, urethra, cancers of the penis, myxosarcoma, chondrosarcoma, osteosarcoma, chordoma, malignant fibrous histiocytoma, lymphangiosarcoma, mesothelioma, squamous cell carcinoma; epidermoid carcinoma, malignant skin adnexal tumors; adenocarcinoma, hepatoma, hepatocellular carcinoma, renal cell carcinoma, hypernephroma, cholangiocarcinoma, transitional cell carcinoma, choriocarcinoma, seminoma, embryonal cell carcinoma, glioma anaplastic; glioblastoma multiforme neuroblastoma, medulloblastoma, malignant meningioma, malignant schwannoma, neurofibrosarcoma, parathyroid carcinoma, medullary carcinoma of thyroid, bronchial carcinoid, pheochromocytoma, Islet cell carcinoma, malignant carcinoid, malignant paraganglioma, melanoma, Merkel cell neoplasm, cystosarcoma phylloide, salivary cancers, thymic carcinomas, and cancers of the vagina among others.

In one embodiment, the methods described herein are useful for treating a host suffering from a lymphoma or lymphocytic or myelocytic proliferation disorder or abnormality. For example, the subject suffering from a Hodgkin Lymphoma of a Non-Hodgkin Lymphoma. For example; the subject can be suffering from a Non-Hodgkin Lymphoma such as, but not limited to: an AIDS-Related Lymphoma; Anaplastic Large-Cell Lymphoma; Angioimmunoblastic Lymphoma; Blastic NK-Cell Lymphoma; Burkitt's Lymphoma; Burkitt-like Lymphoma (Small Non-Cleaved Cell Lymphoma); Chronic Lymphocytic Leukemia/Small Lymphocytic Lymphoma; Cutaneous T-Cell Lymphoma; Diffuse Large B-Cell Lymphoma; Enteropathy-Type T-Cell Lymphoma; Follicular Lymphoma; Hepatosplenic Gamma-Delta T-Cell Lymphoma; Lymphoblastic Lymphoma; Mantle Cell Lymphoma; Marginal Zone Lymphoma; Nasal T-Cell Lymphoma; Pediatric Lymphoma; Peripheral T-Cell Lymphomas; Primary Central Nervous System Lymphoma; T-Cell Leukemias; Transformed Lymphomas; Treatment-Related T-Cell Lymphomas; or Waldenstrom's Macroglobulinemia.

Alternatively, the subject may be suffering from a Hodgkin Lymphoma, such as, but not limited to: Nodular Sclerosis Classical Hodgkin's Lymphoma (CHL); Mixed Cellularity CHL; Lymphocyte-depletion CHL; Lymphocyte-rich CHL; Lymphocyte Predominant Hodgkin Lymphoma; or Nodular Lymphocyte Predominant HL.

In one embodiment, the subject may be suffering from a specific T-cell, a B-cell, or a NK-cell based lymphoma, proliferative disorder, or abnormality. For example, the subject can be suffering from a specific T-cell or NK-cell lymphoma, for example, but not limited to: Peripheral T-cell lymphoma, for example, peripheral T-cell lymphoma and peripheral T-cell lymphoma not otherwise specified (PTCL-NOS); anaplastic large cell lymphoma, for example anaplastic lymphoma kinase (ALK) positive, ALK negative anaplastic large cell lymphoma, or primary cutaneous anaplastic large cell lymphoma; angioimmunoblastic lymphoma; cutaneous T-cell lymphoma, for example mycosis fungoides, Sézary syndrome, primary cutaneous anaplastic large cell lymphoma, primary cutaneous CD30+ T-cell lymphoproliferative disorder; primary cutaneous aggressive epidermotropic CD8+ cytotoxic T-cell lymphoma; primary cutaneous gamma-delta T-cell lymphoma; primary cutaneous small/medium CD4+ T-cell lymphoma. and lymphomatoid papulosis; Adult T-cell Leukemia/Lymphoma (ATLL); Blastic NK-cell Lymphoma; Enteropathy-type T-cell lymphoma; Hematosplenic gamma-delta T-cell Lymphoma; Lymphoblastic Lymphoma; Nasal NK/T-cell Lymphomas; Treatment-related T-cell lymphomas; for example lymphomas that appear after solid organ or bone marrow transplantation: T-cell prolymphocytic leukemia; T-cell large granular lymphocytic leukemia; Chronic lymphoproliferative disorder of NK-cells; Aggressive NK cell leukemia; Systemic EBV+ T-cell lymphoproliferative disease of childhood (associated with chronic active EBV infection); Hydroa vacciniforme-like lymphoma; Adult T-cell leukemia/lymphoma; Enteropathy-associated T-cell lymphoma; Hepatosplenic 'I'-cell lymphoma; or Subcutaneous panniculitis-like 'I'-cell lymphoma.

Alternatively, the subject may be suffering from a specific B-cell lymphoma or proliferative disorder such as, but not limited to: multiple myeloma; Diffuse large B cell lymphoma; Follicular lymphoma; Mucosa-Associated Lymphatic Tissue lymphoma. (MALT); Small cell lymphocytic lymphoma; Mantle cell lymphoma (MCL); Burkitt lymphoma; Mediastinal large B cell lymphoma; Waldenstrom macroglobulinemia; Nodal marginal zone B cell lymphoma (NMZL); Splenic marginal zone lymphoma (SMZL); Intravascular large B-cell lymphoma; Primary effusion lymphoma; or Lymphomatoid granulomatosis; Chronic lymphocytic leukemia/small lymphocytic lymphoma; B-cell prolymphocytic leukemia; Hairy cell leukemia; Splenic lymphoma leukemia, unclassifiable; Splenic diffuse red pulp small B-cell lymphoma; Hairy cell leukemia-variant; Lymphoplasmacytic lymphoma; Heavy chain diseases, for example, Alpha heavy chain disease, Gamma heavy chain disease, Mu heavy chain disease; Plasma cell myeloma; Solitary plasmacytoma of bone; Extraosseous plasmacytoma; Primary cutaneous follicle center lymphoma; T cell/histiocyte rich large B-cell lymphoma; DLBCL associated with chronic inflammation; Epstein-Barr virus (EBV)+ DLBCL of the elderly; Primary mediastinal (thymic) large B-cell lymphoma; Primary cutaneous DLBCL, leg type; ALK+large B-cell lymphoma; Plasmablastic lymphoma; Large B-cell lymphoma arising in HHV8-associated multicentric; Castleman disease; B-cell lymphoma, unclassifiable, with features intermediate between diffuse large B-cell lymphoma and Burkitt lymphoma; B-cell lymphoma, unclassifiable, with features intermediate between diffuse large B-cell lymphoma and classical Hodgkin lymphoma; Nodular sclerosis classical Hodgkin lymphoma; Lymphocyte-rich classical Hodgkin lymphoma; Mixed cellularity classical Hodgkin lymphoma; or Lymphocyte-depleted classical Hodgkin lymphoma.

In one embodiment, the subject is suffering from a leukemia. For example, the subject may be suffering from an acute or chronic leukemia of a lymphocytic or myelogenous origin, such as, but not limited to: Acute lymphoblastic leukemia (ALL); Acute myelogenous leukemia (AML); Chronic lymphocytic leukemia (CLL); Chronic myelogenous leukemia (CML); juvenile myelomonocytic leukemia (JMML); hairy cell leukemia (HCL); acute promyelocytic leukemia (a subtype of AML); T-cell prolymphocytic leukemia (TPLL); large granular lymphocytic leukemia; or Adult T-cell chronic leukemia; large granular lymphocytic leukemia (LGL). In one embodiment, the patient suffers from an acute myelogenous leukemia, for example an undifferentiated AML (M0); myeloblastic leukemia (M1; with/without minimal cell maturation); myeloblastic leukemia (M2; with cell maturation); promyelocytic leukemia (M3 or M3 variant [M3V]); myelomonocytic leukemia (M4 or M4 variant with eosinophilia [M4E]); monocytic leukemia (M5); erythroleukemia (M6); or megakaryoblastic leukemia (M7).

In a particular embodiment, the subject is suffering, or suspected to be suffering from, a breast cancer, lung cancer, a colon cancer, pancreatic cancer, or brain cancer. In a particular embodiment, the subject is suffering from, or suspected to be suffering from, a breast cancer.

In the particular embodiment of cancer, patients at high risk of experiencing the clinical event may receive chemotherapy or targeted therapy in addition to standard of care treatment modalities such as, but not limited to, surgery, radiotherapy, (targeted) drug therapy. Alternatively, patients at low risk of experiencing the clinical event may refrain from standard of care modalities such as, but not limited to, surgery, radiotherapy, chemotherapy.

In one embodiment, the determination of whether to administer a therapeutic, or refrain from administering a therapeutic, can be based on a threshold MPS score, for example a threshold established for assigning a patient to a low risk group or a threshold established for assigning a patient to a high risk group. For example, in one embodiment, the threshold for assigning patients to the low risk group may be based on the risk of the clinical event at 5, 6, 7, 8, 9, 10, or more years being smaller than or equal 5?, 10%, 15%, 20%, whereas the threshold for assigning patients to the high risk group may be based on the risk of the clinical event at 5, 6, 7, 8, 9, 10, or more years being larger or equal to 20%, 25%, 30%, 35%, 40%, 45%, 50%, or greater. For example, using the illustration above, in the particular case of $MPS_{tpwch}$ this results in a threshold for the low risk patient group being −0.5, −0.4, −0.3, −0.2, −0.1, 0 and the threshold for the high risk patient group being 0, 0.1, 0.2, 0.3, 0.4, 0.5, 0.6, 0.7, 0.8, 0.9, 1, 1.1, 1.2.

In one aspect of the present disclosure, the clinical event for which a subject may be assigned into a low risk or high risk group may include a cancer recurrence, progression, metastasis, death due to cancer, or a clinical event as described elsewhere herein.

In the particular embodiment, the assignment of a high risk or low risk is for a subject with breast cancer, patients with a ER+ or HR+ tumor or luminal A or luminal B subtype (i.e., a tumor sample that has stained positive for ER or a hormone receptor (HR)) and at high risk of experiencing the clinical event may receive (neo)adjuvant chemotherapy in addition to hormone treatment such as, but not limited to, tamoxifen or aromatase inhibitors. ER+ tumor or luminal A or luminal B subtype and at low risk of experiencing the clinical event may receive (neo)adjuvant hormone treatment (and refrain from chemotherapy). Patients with a HER2+/HR-tumor or HER2 enriched subtype and at high risk of experiencing the clinical event may receive (neo)adjuvant chemotherapy in addition to anti-HER2 treatment such as, but not limited to, trastuzumab, whereas HER2+/HR− tumor or HER2 enriched subtype and at low risk of experiencing the clinical event may receive (neo)adjuvant anti-HER2 treatment (and refrain from chemotherapy). Patients with a HER2+/HR+ tumor and at a high risk of experiencing the clinical event may receive (neo)adjuvant chemotherapy with anti-HER2 treatment in addition to hormone treatment such as, but not limited to, tamoxifen or aromatase inhibitors, whereas patients with a HER2+/HR+ tumor and a low risk of experiencing the clinical event may receive (neo)adjuvant hormone treatment (and refrain from chemotherapy and/or anti-HER2 treatment). Patients with a triple negative (HER2-/ER-/PR- or HER2-/HR-) tumor or basal subtype and at a high risk of experiencing the clinical event may receive (neo)adjuvant chemotherapy in addition to targeted therapy such as, but not limited to, described herein, whereas patients with a triple negative tumor or basal subtype and a low risk of experiencing the clinical event may receive (neo)adjuvant targeted therapy (and refrain from chemotherapy).

The sample(s) to be used in accordance with the present disclosure can be an extracted sample, that is, a sample that has been extracted from the subject. Examples of the sample include, but are not limited to, a tissue, cells, blood and/or a body fluid of a subject. It can be, e.g., a sample obtained from a cancer lesion, or from a lesion suspected for cancer, or from a metastatic tumor, or from a body cavity in which fluid is present which is contaminated with cancer cells (e.g., pleural or abdominal cavity or bladder cavity), or from other body fluids containing cancer cells, and so forth, for example, via a biopsy procedure or other sample extraction procedure. The cells of which a sample is extracted may also be tumorous cells from hematologic malignancies (such as leukemia or lymphoma), in some cases, the cell sample may also be circulating tumor cells, that is, tumor cells that have entered the bloodstream and may be extracted using suitable isolation techniques, e.g., apheresis or conventional venous blood withdrawal. Aside from blood, a body fluid of which a sample is extracted may be urine, gastrointestinal contents, or an extravasate.

In one embodiment, provided herein is a method that further comprises combining the risk score and/or at least one of the inferred activities with one or more additional risk scores obtained from one or more additional prognostic tests to obtain a combined risk score, wherein the combined risk score indicates a risk that the subject will experience the clinical event within the certain period of time. The one or more additional prognostic tests may comprise, in particular, the Oncotype DX® breast cancer test, the Mammostrat® breast cancer test, the MammaPrint® breast cancer test, the EndoPredict® breast cancer test, the BluePrint™ breast cancer test, the CompanDx® breast cancer test, the Breast Cancer Index$^{SM}$ (HOXB13/IL17BR), the OncotypeDX® colon cancer test, and/or a proliferation test performed by measuring expression of gene/protein Ki67.

In one embodiment, the clinical event is one of recurrence of cancer, progression of cancer, occurrence of cancer, and death caused by cancer, wherein, in particular; the cancer is breast cancer. The risk that the clinical event will occur within the certain period of time is then preferentially the risk of recurrence, i.e., the return, of cancer, either after a given treatment (also called "cancer therapy response prediction") or without any treatment (also called "cancer prognosis"). The recurrence can be either local (i.e., at the side of the original tumor), or distant (i.e., metastasis, beyond the original side). In other alternatives, the risk that the clinical event will occur within the certain period of time is the risk of progression of cancer, the risk of occurrence of cancer, or the risk of death caused by cancer. In one embodiment, the clinical event is death. In one embodiment, the clinical event is disease recurrence. In one embodiment, the clinical event is disease progression. In one embodiment, the clinical event is death. In one embodiment, the clinical event is survival.

In one embodiment, the risk monotonically increases with an increasing activity level of the TGF-β cellular signaling pathway, the PI3K cellular signaling pathway, the Wnt cellular signaling pathway, and the HH cellular signaling pathway in the sample, and monotonically decreases with an increasing activity level of the ER cellular signaling pathway in the sample.

Another aspect of the present disclosure relates to a method (as described herein), further comprising:

assigning the subject to at least one of a plurality of risk groups associated with different indicated risks that the subject will experience the clinical event within the certain period of time, and/or deciding a treatment recommended for the subject based at least in part on the indicated risk that the subject will experience the clinical event within the certain period of time.

The present disclosure also relates to a method (as described herein), comprising:

calculating the activity of the TGF-β pathway in the subject based at least on expression levels of two, three or more target genes of a set of target genes of the TGF-β pathway measured in the sample of the subject, and/or calculating the activity of the PI3K pathway in the subject based at least on expression levels of two, three or more target genes of a set of target genes of the PI3K pathway measured in the sample of the subject, and/or calculating the activity of the Wnt pathway in the subject based at least on expression levels of two, three or more target genes of a set of target genes of the Wnt pathway measured in the sample of the subject, and/or calculating the activity of the ER pathway in the subject based at least on expression levels of two, three or more target genes of a set of target genes of the ER pathway measured in the sample of the subject, and/or calculating the activity of the HH pathway in the subject based at least on expression levels of two, three or more target genes of a set of target genes of the HH pathway measured in the sample of the subject.

In an embodiment the set of target genes of the TGF-β pathway includes at least seven, or in an alternativer embodiment, all target genes selected from the group consisting of: ANGPTL4, CDC42EP3, CDKN1A, CDKN2B, CTGF, GADD45A, GADD45B, HMGA2, ID1, IL11, INPP5D, JUNB, MMP2, MMP9, NKX2-5, OVOL1, PDGFB, PTHLH, SGK1, SKIL, SMAD4, SMAD5, SMAD6, SMAD7, SNAI1, SNAI2, TIMP1, and VEGFA, or in the alternative, from the group consisting of: ANGPTL4, CDC42EP3, CDKN1A, CTGF, GADD45A, GADD45B, HMGA2, ID1, IL11, JUNB, PDGFB, PTHLH, SGK1, SKIL, SMAD4, SMAD5, SMAD6, SMAD7, SNAI2, and VEGFA, or in alternative, from the group consisting of: ANGPTL4, CDC42EP3, CDKN1A, CTGF, GADD45B, ID1, IL11, JUNB, PDGFB, SKIL, SMAD7, and SNAI2, or in an alternative, from the group consisting of: ANGPTL4, CDC42EP3, ID1, IL11, JUNB, SKIL, and SMAD7, and/or the set of target genes of the PI3K pathway includes at least nine, or in an alternative, all target genes selected from the group consisting of: AGRP, BCL2L11, BCL6, BNIP3, BTG1, CAT, CAV1, CCND1, CCND2, CCNG2, CDKN1A, CDKN1B, ESR1, FASLG, FBXO32, GADD45A, INSR, MXI1, NOS3, PCK1, POMC, PPARGC1A, PRDX3, RBL2, SOD2, and TNFSF10, and/or the set of target genes of the Wnt pathway includes at least nine, or in an alternative, all target genes selected from the group consisting of: KIAA1199 (CEMIP), AXIN2, CD44, RNF43, MYC, TBX3, TDGF1, SOX9, ASCL2, IL8 (CXCL8), SP5, ZNRF3, EPHB2, LGR5, EPHB3, KLF6, CCND1, DEFA6, and FZD7, and/or the set of target genes of the ER pathway includes at least nine, in an alternative, all target genes selected from the group consisting of: GREB1, PGR, XBP1, CA12, SOD1, CTSD, IGFBP4, TFF1, SGK3, NRIP1, CELSR2, WISP2, and AP1B1, and/or the set of target genes of the HH pathway includes at least nine, or in an alternative, all target genes selected from the group consisting of: GLI1, PTCH1 PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1.

In one embodiment, provided herein is a method wherein
the set of target genes of the PI3K pathway further includes:

(i) at least one target gene selected from the group consisting of: ATP8A1, C10orf10, CBLB, DDB1, DYRK2, ERBB3, EREG, EXT1, FGFR2, IGF1R, IGFBP1, IGFBP3, LGMN, PPM1D, SEMA3C, SEPP1, SESN1, SLC5A3, SMAD4, and TLE4, and/or (ii) at least one target gene selected from the group consisting of: ATG14, BIRC5, IGFBP1, KLF2, KLF4, MYOD1, PDK4, RAG1, RAG2, SESN1, SIRT1, STK11 and TXNIP, and/or the set of target genes of the Wnt pathway further includes at least one target gene selected from the group consisting of: NKD1, OAT, FAT1, LEF1, GLUL, REG1B, TCF7L2, COL18A1, BNIP7, SLC1A2, ADRA2C, PPARG, DKK1, HNF1A, and LECT2, and/or the set of target genes of the ER pathway further includes at least one target gene selected from the group consisting of: RARA, MYC, DSCAM, EBAG9, COX7A2L, ERBB2, PiSD, KRT19, HSPB1, TRIM25, PTMA, COL18A1, CDH26, NDUFV3, PRDM15, ATP5J, and ESR1, and/or the set of target genes of the HH pathway further includes at least one target gene selected from the group consisting of: BCL2, FOXA2, FOXF1, H19, HHIP, IL1R2, JAG2, JUP, MIF, MYLK, NKX2.2, NKX2.8, PITRM1, and TOM1.

If the set of target genes of the PI3K pathway further includes both at least one target gene of the PI3K pathway selected from the group (i) and at least one target gene of the PI3K pathway selected from the group (ii), the target genes IGFBP1 and SESN1, which are mentioned above with respect to both groups, may only be contained in one of the groups.

The present disclosure as described herein can, e.g., also advantageously be used in connection with prognosis and/or prediction based at least in part on a combination of inferred activities of two or more cellular signaling pathways, and/or prediction of drug efficacy of e.g. chemotherapy and/or hormone treatment and/or targeted treatment such as, but not limited to, trastuzumab, everolimus, lapatinib and/or pertuzumab based at least in part on a combination of inferred activities of two or more cellular signaling pathways, and/or monitoring of drug efficacy based at least in part on a combination of inferred activities of two or more cellular signaling pathways, and/or deciding on the frequency of monitoring or more particularly on the frequency of therapy response monitoring, and/or drug development based at least in part on a combination of interred activities of two or more cellular signaling pathways, and/or assay development based at least in part on a combination of inferred activities of two or more cellular signaling pathways, and/or cancer staging based at least in part on a combination of inferred activities of two or more cellular signaling pathways, wherein in each case, the cellular signaling pathways comprise a TGF-β pathway and one or more of a PI3K pathway, a Wnt pathway, an ER pathway, and an HH pathway.

Further advantages will be apparent to those of ordinary skill in the art upon reading and understanding the attached figures, the following description and, in particular, upon reading the detailed examples provided herein below.

EXAMPLES

The following examples merely illustrate exemplary methods and selected aspects in connection therewith. The teaching provided therein may be used for constructing several tests and/or kits, e.g., to detect, predict and/or diagnose the abnormal activity of the TGF-β pathway and one or more of a PI3K pathway, a Wnt pathway, an ER pathway, and an HH pathway and a risk score based thereon. These tests and/or kits can identify a subject at risk of experiencing a clinical event associated with a disease within a defined period of time. Furthermore, upon using methods as described herein drug prescription can advantageously be guided, drug response prediction and monitoring of drug efficacy (and/or adverse effects) can be made, and drug resistance can be predicted and monitored, e.g., to select subsequent test(s) to be performed (like a companion diagnostic test). The following examples are not to be construed as limiting the scope of the present disclosure.

Example 1: Calculating Activity of Two or More Cellular Signaling Pathways

As described in detail in the published international patent application WO 2013/011479 A2 ("Assessment of cellular signaling pathway activity using probabilistic modeling of target gene expression"), by constructing a probabilistic model, e.g., a Bayesian model, and incorporating conditional probabilistic relationships between expression levels of a number of different target genes and the activity of the cellular signaling pathway, such a model can be used to determine the activity of the cellular signaling pathway with a high degree of accuracy. Moreover, the probabilistic model can be readily updated to incorporate additional knowledge obtained by later clinical studies, by adjusting the conditional probabilities and/or adding new nodes to the model to represent additional information sources. In this way, the probabilistic model can be updated as appropriate to embody the most recent medical knowledge.

When using this approach, the target genes of the Wnt pathway, the ER pathway, and the HH pathway can be, for example, selected according to the methods described in section "Example 3: Selection of target genes" of WO 2013/011479 A2 and the probabilistic model is, for example, trained according to the methods described in "Example 5: Training and using the Bayesian network" of WO 2013/011479 A2. A suitable choice of the target gene(s) that are used for determining the activity of the Wnt pathway, the ER pathway, and the AR pathway is defined in the appended claims.

In another easy to comprehend and interpret approach described in detail in the published international patent application WO 2014/102668 A2 ("Assessment of cellular signaling pathway activity using linear combination(s) of target gene expressions"), the activity of a certain cellular signaling pathway is determined by constructing a mathematical model (e.g., a linear or (pseudo-)linear model) incorporating relationships between expression levels of one or more target gene(s) of a cellular signaling pathway and the level of a transcription factor (TF) element; the TF element controlling transcription of the one or more target gene(s) of the cellular signaling pathway, the model being based at least in part on one or more linear combination(s) of expression levels of the one or more target gene(s).

When using this approach, the target genes of the Wnt pathway, the ER pathway, and the HIT pathway are, for example, selected according to the methods described in sections "Example 2: Selection of target genes" and "Example 3: Comparison of evidence curated list and broad literature list" of WO 2014/102668 A2 and the mathematical model is, for example, trained according to the methods described in "Example 4: Training and using the mathematical model" of WO 2014/102668 A2. The choice of the target gene(s) defined in the appended claims is also useful for determining the activity of the Wnt pathway, the ER pathway, and the HH pathway with this later approach.

With respect to the two different approaches, the expression levels of the one or more target gene(s) may, for example, be measurements of the level of mRNA, which can be the result of, e.g., (RT)-PCR and microarray techniques using probes associated with the target gene(s) mRNA sequences, and of RNA-sequencing. In another embodiment the expression levels of the one or more target gene(s) can be measured by protein levels, e.g., the concentrations of the proteins encoded by the target genes.

The aforementioned expression levels may optionally be converted in many ways that might or might not suit the application better. For example, four different transformations of the expression levels, e.g., microarray-based mRNA levels, may be:

"continuous data", i.e., expression levels as obtained after preprocessing of microarrays using well known algorithms such as MAS5.0 and fRMA, "z-score", i.e., continuous expression levels scaled such that the average across all samples is 0 and the standard deviation is 1, "discrete", i.e., every expression above a certain threshold is set to 1 and below it to 0 (e.g., the threshold for a probeset may be chosen as the median of its value in a set of a number of positive and the same number of negative clinical samples), "fuzzy", i.e., the continuous expression levels are converted to values between 0 and 1 using a sigmoid function of the following format: 1/(1+exp((thr−expr)/se)), with expr being the continuous expression levels, thr being the threshold as mentioned before and se being a softening parameter influencing the difference between 0 and 1.

One of the simplest models that can be constructed is a model having a node representing the transcription factor (TF) element in a first layer and weighted nodes representing direct measurements of the target gene(s) expression intensity levels, e.g., by one probeset that is particularly highly correlated with the particular target gene, e.g., in microarray or (q)PCR experiments, in a second layer. The weights can be based either on calculations from a training data set or based on expert knowledge. This approach of using, in the case where possibly multiple expression levels are measured per target gene (e.g., in the case of microarray experiments, where one target gene can be measured with multiple probesets), only one expression level per target gene is particularly simple. A specific way of selecting the one expression level that is used for a particular target gene is to use the expression level from the probeset that is able to separate active and passive samples of a training data set the best. One method to determine this probeset is to perform a statistical test, e.g., the t-test, and select the probeset with the lowest p-value. The training data set's expression levels of the probe with the lowest p-value is by definition the probe with the least likely probability that the expression levels of the (known) active and passive samples overlap. Another selection method is based on odds-ratios, in such a model, one or more expression level(s) are provided for each of the one or more target gene(s) and the one or more linear combination(s) comprise a linear combination including for each of the one or more target gene(s) a weighted term, each weighted term being based on only one expression level of the one or more expression level(s) provided for the respective target gene. If the only one expression level is chosen per target gene as described above, the model may be called a "most discriminant probesets" model.

In an alternative to the "most discriminant probesets" model, it is possible, in the case where possibly multiple expression levels are measured per target gene, to make use of all the expression levels that are provided per target gene. In such a model, one or more expression level(s) are provided for each of the one or more target gene(s) and the one or more linear combination(s) comprise a linear combination of all expression levels of the one or more expression level(s) provided for the one or more target gene(s). In other words, for each of the one or more target gene(s), each of the one or more expression level(s) provided for the respective target gene may be weighted in the linear combination by its own (individual) weight. This variant may be called an "all probesets" model. It has an advantage of being relatively simple while making use of all the provided expression levels.

Both models as described above have in common that they are what may be regarded as "single-layer" models, in which the level of the TF element is calculated based on a linear combination of expression levels.

After the level of the TF element has been determined by evaluating the respective model, the determined TF element level can be thresholded in order to infer the activity of the cellular signaling pathway. A method to calculate such an appropriate threshold is by comparing the determined TF element level w/c of training samples known to have a passive pathway and training samples with an active pathway. A method that does so and also takes into account the variance in these groups is given by using a threshold $$thr = \frac{\sigma_{wlc_{pas}}\mu_{wlc_{act}} + \sigma_{wlc_{act}}\mu_{wlc_{pas}}}{\sigma_{wlc_{pas}} + \sigma_{wlc_{act}}} \quad (1)$$

Where σ and μ are the standard deviation and the mean of the training samples. In case only a small number of samples are available in the active and/or passive training samples, a pseudocount may be added to the calculated variances based on the average of the variances of the two groups:

$$\tilde{v} = \frac{v_{wlc_{act}} + v_{wlc_{pas}}}{2} \quad (2)$$

$$\tilde{v}_{wlc_{act}} = \frac{x\tilde{v} + (n_{act} - 1)v_{wlc_{act}}}{x + n_{act} - 1}$$

$$\tilde{v}_{wlc_{pas}} = \frac{x\tilde{v} + (n_{pas} - 1)v_{wlc_{pas}}}{x + n_{pas} - 1}$$

where v is the variance of the determined TF element levels w/c of the groups, x is a positive pseudocount, e.g., 1 or 10, and $n_{act}$ and $n_{pas}$ are the number of active and passive samples, respectively. The standard deviation σ can next be obtained by taking the square root of the variance v. The threshold can be subtracted from the determined level of the TF element w/c for ease of interpretation, resulting in the cellular signaling pathway's activity score, such that negative values corresponds to a passive cellular signaling pathway and positive values to an active cellular signaling pathway.

As an alternative to the described "single-layer" models, a "two-layer" model representing the experimental determination of active signaling of a pathway can be used. For every target gene a summary level is calculated using a linear combination based on the measured intensities of its associated probesets ("first (bottom) layer"). The calculated summary value is subsequently combined with the summary values of the other target genes of the pathway using a further linear combination ("second (upper) layer"). The weights can be either learned from a training data set or based on expert knowledge or a combination thereof. Phrased differently, in the "two-layer" model, one or more expression level(s) are provided for each of the one or more target gene(s) and the one or more linear combination(s) comprise for each of the one or more target gene(s) a first linear combination of all expression levels of the one or more expression level(s) provided for the respective target gene ("first (bottom) layer"). The model is further based at least in part on a further linear combination including for each of the one or more target gene(s) a weighted term, each weighted term being based on the first linear combination for the respective target gene ("second (upper) layer").

The calculation of the summary values can, in an exemplary version of the "two-layer" model, include defining a threshold for each target gene using the training data and subtracting the threshold from the calculated linear combination, yielding the gene summary. Here, the threshold may be chosen such that a negative gene summary level corresponds with a downregulated target gene and that a positive gene summary level corresponds with an upregulated target gene. Also, it is possible that the gene summary values are transformed using e.g. one of the above-mentioned transformations (fuzzy, discrete, etc.) before they are combined in the "second (upper) layer".

After the level of the TF element has been determined by evaluating the "two-layer" model, the determined TF element level can be thresholded in order to infer the activity of the cellular signaling pathway, as described above.

Herein, the models described above with reference to WO 2014/102668 A2 are collectively denoted as "(pseudo-) linear models".

While the above description regarding the mathematical model construction also applies to the calculating of the activity of the TGF-β pathway and the PI3K pathway, the selection of the target genes and the training and use of the mathematical model was modified to some extend for the TGF-β pathway and the PI3K pathway compared to the Wnt pathway, the ER pathway, and the HH pathway. These steps will therefore be described for the TGF-β pathway in more detail in the following. Thereafter, this will be described for the PI3K pathway:

(A) TGF-β Pathway
(i) Selection of Target Genes

A transcription factor (TF) is a protein complex (i.e., a combination of proteins bound together in a specific structure) or a protein that is able to regulate transcription from target genes by binding to specific DNA sequences, thereby controlling the transcription of genetic information from DNA to mRNA. The mRNA directly produced due to this action of the TF complex is herein referred to as a "direct target gene" (of the transcription factor). Cellular signaling pathway activation may also result in more secondary gene transcription, referred to as "indirect target genes". In the following, (pseudo-)linear models or Bayesian network models (as exemplary mathematical models) comprising or consisting of direct target genes as direct links between cellular signaling pathway activity and mRNA level, are exemplified, however the distinction between direct and indirect target genes is not always evident. Herein, a method to select direct target genes using a scoring function based on available scientific literature data is presented. Nonetheless, an accidental selection of indirect target genes cannot be ruled out due to limited information as well as biological variations and uncertainties. In order to select the target genes, the MEDLINE database of the National Institute of Health accessible at "ncbi.nlm.nih.gov/pubmed" and herein further referred to as "Pubmed" was employed to generate a list of selected target genes.

Publications containing putative TGF-β target genes were searched for by using queries such as ("TGF-β" AND "target gene") in the period of fourth quarter of 2013 and the first quarter of 2014. The resulting publications were further analyzed manually following the methodology described in more detail below.

Specific cellular signaling pathway mRNA target genes were selected from the scientific literature, by using a ranking system in which scientific evidence for a specific target gene was given a rating, depending on the type of scientific experiments in which the evidence was accumulated. While some experimental evidence is merely suggestive of a gene being a direct target gene, like for example an mRNA increasing as detected by means of an increasing intensity of a probeset on a microarray of a cell line in which it is known that the TGF-β cellular signaling axis is active, other evidence can be very strong, like the combination of an identified cellular signaling pathway TF binding site and retrieval of this site in a chromatin immunoprecipitation (ChIP) assay after stimulation of the specific cellular signaling pathway in the cell and increase in mRNA after specific stimulation of the cellular signaling pathway in a cell line.

Several types of experiments to find specific cellular signaling pathway target genes can be identified in the scientific literature:

1. ChIP experiments in which direct binding of a TF of the cellular signaling pathway of interest to its binding site on the genome is shown. Example: By using chromatin immunoprecipitation (ChIP) technology subsequently putative functional TGF-β TF binding sites in the DNA of cell lines with and without active induction of the TGF-β pathway, e.g., by stimulation with TGF-β, were identified, as a subset of the binding sites recognized purely based on nucleotide sequence. Putative functionality was identified as ChIP-derived evidence that the TF was found to bind to the DNA binding site.

2. Electrophoretic Mobility Shift (EMSA) assays which show in vitro binding of a TF to a fragment of DNA containing the binding sequence. Compared to ChIP-based evidence EMSA-based evidence is less strong, since it cannot be translated to the in vivo situation.

3. Stimulation of the cellular signaling pathway and measuring mRNA expression using a microarray, RNA sequencing, quantitative PCR or other techniques, using cellular signaling pathway-inducible cell lines and measuring mRNA profiles measured at least one, but in certain embodiments several time points after induction—in the presence of cycloheximide, which inhibits translation to protein, thus the induced mRNAs are assumed to be direct target genes.

4. Similar to 3, but alternatively measure the mRNAs expression further downstream with protein abundance measurements, such as western blot.

Identification of TF binding sites in the genome using a bioinformatics approach. Example for the TGF-β TF element: Using the SMAD binding motif 5'-AGAC-3', a software program was run on the human genome sequence, and potential binding sites were identified, both in gene promoter regions and in other genomic regions.

6. Similar as 3, only in the absence of cycloheximide.
7. Similar to 4, only in the absence of cycloheximide.

In the simplest form one can give every potential gene 1 point for each of these experimental approaches in which the gene was identified as being a target gene of the TGF-13 family of transcription factors. Using this relative ranking strategy, one can make a list of most reliable target genes.

Alternatively, ranking in another way can be used to identify the target genes that are most likely to be direct target genes, by giving a higher number of points to the technology that provides most evidence for an in vivo direct target gene. In the list above, this would mean 8 points for experimental approach 1), 7 for 2), and going down to 1 point for experimental approach 8). Such a list may be called a "general list of target genes".

Despite the biological variations and uncertainties, the inventors assumed that the direct target genes are the most likely to be induced in a tissue-independent manner. A list of these target genes may be called an "evidence curated list of target genes". Such an evidence curated list of target genes has been used to construct computational models of the TGF-β pathway that can be applied to samples coming from different tissue sources.

The following will illustrate exemplary how the selection of an evidence curated target gene list specifically was constructed for the TGF-β pathway.

A scoring function was introduced that gave a point for each type of experimental evidence, such as ChIP, EMSA, differential expression, knock down/out, luciferase gene reporter assay, sequence analysis, that was reported in a publication. The same experimental evidence is sometimes mentioned in multiple publications resulting in a corresponding number of points, e.g., two publications mentioning a ChIP finding results in twice the score that is given for a single ChIP finding. Further analysis was performed to allow only for genes that had diverse types of experimental evidence and not only one type of experimental evidence, e.g., differential expression. Those genes that had more than one type of experimental evidence available were selected (as shown in Table 1).

A further selection of the evidence curated list of target genes (listed in Table 1) was made by the inventors. The target genes of the evidence curated list that were proven to be more probative in determining the activity of the TGF-β pathway from the training samples were selected. Herein, samples from GSE17708 stimulated with 5 ng/mL TGF-β for 4 hours were chosen as active or tumor promoting TGF-β activity whereas the unstimulated samples were chosen as the passive or tumor suppressing TGF-β samples for training, alternatively, one can use patient samples of primary cells or other cell lines stimulated with and deprived of TGF-β, e.g. GSE6653, GSE42373 and GSE18670. All target genes that had a "soft" odds ratio between active and passive training samples of more than 2 or less than 0.5 for negatively regulated target genes were selected for the "20 target genes shortlist". Target genes that were found to have a "soft" odds ratio of more than 10 or less than 0.1 are selected for the "12 target genes shortlist". The "7 target genes shortlist" consists of target genes that were found to have a "soft" odds ratio of more than 15 or less than 1/15. The 20 target genes shortlist, the 12 target genes shortlist, and the 7 target genes shortlist are shown in Tables 2 to 4, respectively.

TABLE 1

"Evidence curated list of target genes" of the TGF-β pathway used in the TGF-β pathway models and associated probesets used to measure the mRNA expression level of the target genes.

| Target gene | Probeset |
| --- | --- |
| ANGPTL4 | 223333_s_at |
|  | 221009_s_at |
| CDC42EP3 | 209286_a |
|  | 209288_s_at |
|  | 225685_at |
|  | 209287_s_at |
| CDKN1A | 202284_s_at |
|  | 1555186_at |
| CDKN2B | 236313_at |
|  | 207530_s_at |
| CTGF | 209101_at |
| GADD45A | 203725_at |
| GADD45B | 207574_s_at |
|  | 209305_s_at |
|  | 209304_x_at |
| HMGA2 | 208025_s_at |
|  | 1567224_at |
|  | 1568287_at |
|  | 1558683_a_at |
|  | 1561633_at |
|  | 1559891_at |
|  | 1558682_at |
| ID1 | 208937_s_at |
| IL11 | 206924_at |
|  | 206926_s_at |
| INPP5D | 203331_s_at |
|  | 1568943_at |
|  | 203332_s_at |

TABLE 1-continued

"Evidence curated list of target genes" of the TGF-β pathway used in the TGF-β pathway models and associated probesets used to measure the mRNA expression level of the target genes.

| Target gene | Probeset |
| --- | --- |
| JUNB | 201473_at |
| MMP2 | 1566678_at |
|  | 201069_at |
| MMP9 | 203936_s_at |
| NKX2-5 | 206578_at |
| OVOL1 | 206604_at |
|  | 229396_at |
| PDGFB | 204200_s_at |
|  | 216061_x_at |
|  | 217112_at |
|  | 217430_x_at |
| PTHLH | 210355_at |
|  | 206300_s_at |
|  | 1556773_at |
|  | 211756_at |
| SGK1 | 201739_at |
| SKIL | 206675_s_at |
|  | 225227_at |
|  | 215889_at |
| SMAD4 | 202526_at |
|  | 202527_s_at |
|  | 1565703_at |
|  | 235725_at |
| SMAD5 | 225223_at |
|  | 235451_at |
|  | 225219_at |
|  | 205187_at |
|  | 205188_s_at |
| SMAD6 | 207069_s_at |
|  | 209886_s_at |
| SMAD7 | 204790_at |
| SNAI1 | 219480_at |
| SNAI2 | 213139_at |
| TIMP1 | 201666_at |
| VEGFA | 210513_s_at |
|  | 210512_s_at |
|  | 212171_x_at |
|  | 211527_x_at |

TABLE 2

"20 target genes shortlist" of target genes of the TGF-β pathway based on the evidence curated list of target genes.

Target gene

ANGPTL4
CDC42EP3
CDKN1A
CDKN2B
CTGF
GADD45A
GADD45B
HMGA2
ID1
IL11
INPP5D
JUNB
MMP2
MMP9
NKX2_5
OVOL1
PDGFB
PTHLH
SGK1
SKIL
SMAD4
SMAD5
SMAD6
SMAD7
SNAI1
SNAI2

TABLE 2-continued

"20 target genes shortlist" of target genes of the TGF-β pathway based on the evidence curated list of target genes.
Target gene

TIMP1
VEGFA

TABLE 3

"12 target genes shortlist" of target genes of the TGF-β pathway based on the evidence curated list of target genes.
Target gene

ANGPTL4
CDC42EP3
CDKN1A
CTGF
GADD45B
ID1
IL11
JUNB
PDGFB
SKIL
SMAD7
SNAI2

TABLE 4

"7 target genes shortlist" of target genes of the TGF-β pathway based on the evidence curated list of target genes.
Target gene

ANGPTL4
CDC42EP3
ID1
IL11
JUNB
SKIL
SMAD7

A revision of the available literature evidence of TGF-β was performed in January 2015, also including all new scientific papers up to 19 Jan. 2015. Similarly, publications were found using the MEDLINE database of the National Institute of Health accessible at "ncbi.nlm.nih.gov/pubmed" using queries such as ("TGF-β" AND "target gene"). After manually evaluating the scientific papers for experimental evidence of a number of target genes being a putative target gene of TGF-β using the methodology as described in Example 2 above, a number of putative TGF-β target genes, unexploited in the initial evaluation during the fourth quarter of 2013 and first quarter of 2014, were found. All available experimental evidence was reevaluated and a new ranking of putative target genes was prepared based on the strength of the available experimental evidence for the putative target gene using the methodology as described in Example 2. This resulted in one additional putative TGF-β target gene, SERPINE1, achieving an experimental evidence score above the set threshold. Consequently, SERPINE1 was considered to be a bona fide direct target gene of the TGF-β pathway and tested for improved TGF-β pathway activity level calculations.

Using two Bayesian networks based on the 11 highest ranked target genes: ANGPTL4, CDC42EP3, CDKN1A, CTGF, GADD45B, ID1, JUNB, SKIL, SMAD7, SNAI2 and VEGFA plus or minus the newly selected SERPINE1 trained using the same data and methodology as described in above, resulting in a '11-gene list+ SERPINE1' and a '11-gene list' model, respectively.

TABLE 5

"11-gene list + SERPINE1" (or "revised 12 target genes shortlist") list of target genes of the TGF-β cellular signaling pathway includes:
Target gene

ANGPTL4
CDC42EP3
CDKN1A
CTGF
GADD45B
ID1
JUNB
SERPINE1
SKIL
SMAD7
SNAI2
VEGFA

TABLE 6

"11-gene list" of target genes of the TGF-β cellular signaling pathway includes:
Target gene

ANGPTL4
CDC42EP3
CDKN1A
CTGF
GADD45B
ID1
JUNB
SKIL
SMAD7
SNAI2
VEGFA

Based on the additional inclusion of the SERPINE1 gene, the target gene lists (See Tables 5 and 7) can be revised into additional non-limiting embodiments, as described in Tables 11 and 12.

TABLE 7

The "revised 20 target genes shortlist" of target genes of the TGF-β cellular signaling pathway includes:
Target gene ANGPTL4
CDC42EP3
CDKN1A
CTGF
GADD45A
GADD45B
HMGA2
ID1
JUNB
PDGFB
PTHLH
SERPINE1
SGK1
SKIL
SMAD4
SMAD5
SMAD6
SMAD7
SNAI2
VEGFA

TABLE 8

The "revised 7 target genes shortlist" of target genes of the TGF-β cellular signaling pathway includes:
Target gene

ANGPTL4
CDC42EP3
ID1
JUNB
SERPINE1
SKIL
SMAD7

Including one more target gene in the mathematical calculation of the pathway activity is expected to have a small effect on the predictions of the pathway activity, which is anticipated to scale the pathway activity level minutely. In the examples below, it is shown that in addition to this anticipated effect there are also markedly different pathway activity levels in several examples which can only be explained by SERPINE1 having an unexpected, advantageous effect on the pathway activity calculations.

Figure 30:
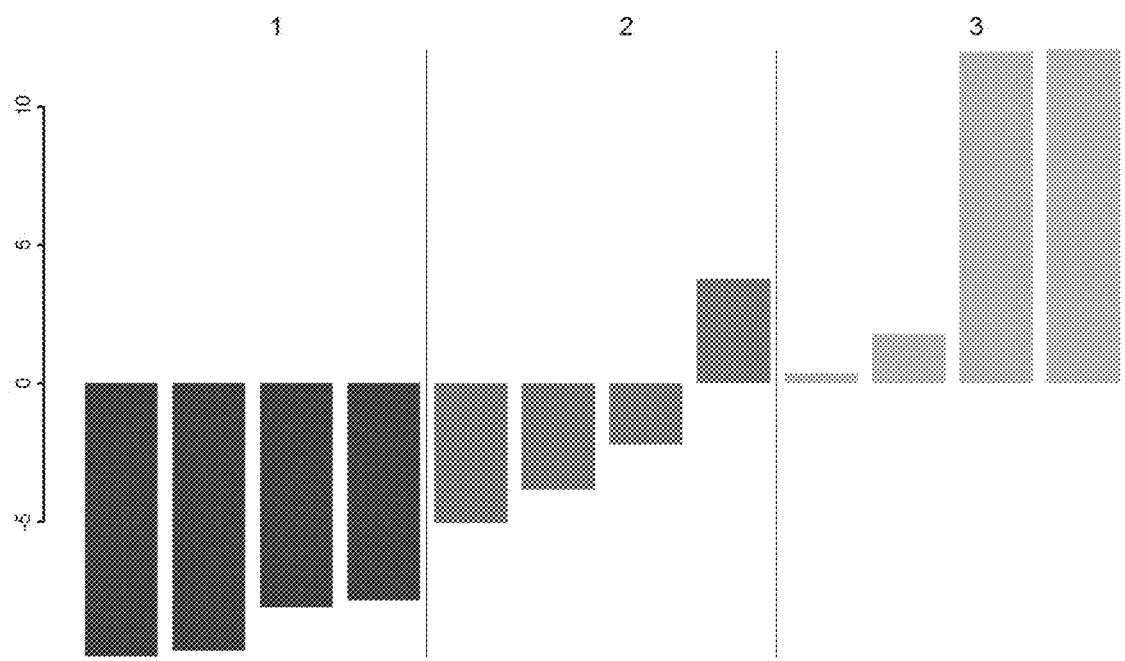
FIG. 30 shows TGF-β pathway activity predictions calculated by the '11-gene list'-Bayesian network on ectocervical epithelial cells (Ect1) stimulated with seminal plasma or 5 ng/mL TGF-β3 (GSE35830). (Legend: 1—Control, no TGF-β; 2—Stimulated with 10% seminal plasma; 3—stimulated with 5 ng/mL TGF-β3)
Figure 31:
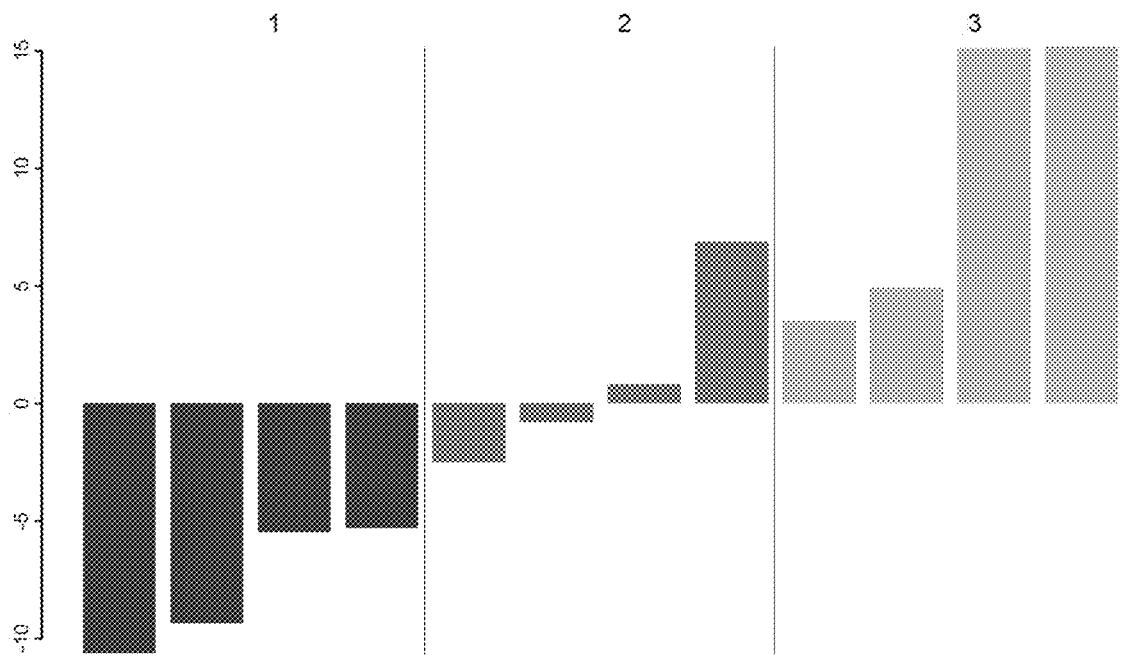
FIG. 31 shows TGF-β pathway activity predictions calculated by the '11-gene list+SERPINE1'-Bayesian network on ectocervical epithelial cells (Ect1) stimulated with seminal plasma or 5 ng/mL TGF-β3 (GSE35830). (Legend: 1—Control, no TGF-β; 2—Stimulated with 10% seminal plasma; 3—stimulated with 5 ng/mL TGF-β3)

FIGS. 30 and 31 show the predictions of TGF-β activity using both models in Ect1 cell lines stimulated with seminal plasma or 5 ng/mL TGF-β3 or without stimulation from GSE35830. It is clearly visible that including SERPINE1 as an additional target gene improves the capability of the model to detect passive samples with higher accuracy. Furthermore, the model predictions of the second group stimulated with seminal plasma and the third group stimulated with TGF-β3 are more accurate as they predict a higher activity of the TGF-β pathway.

Figure 32:
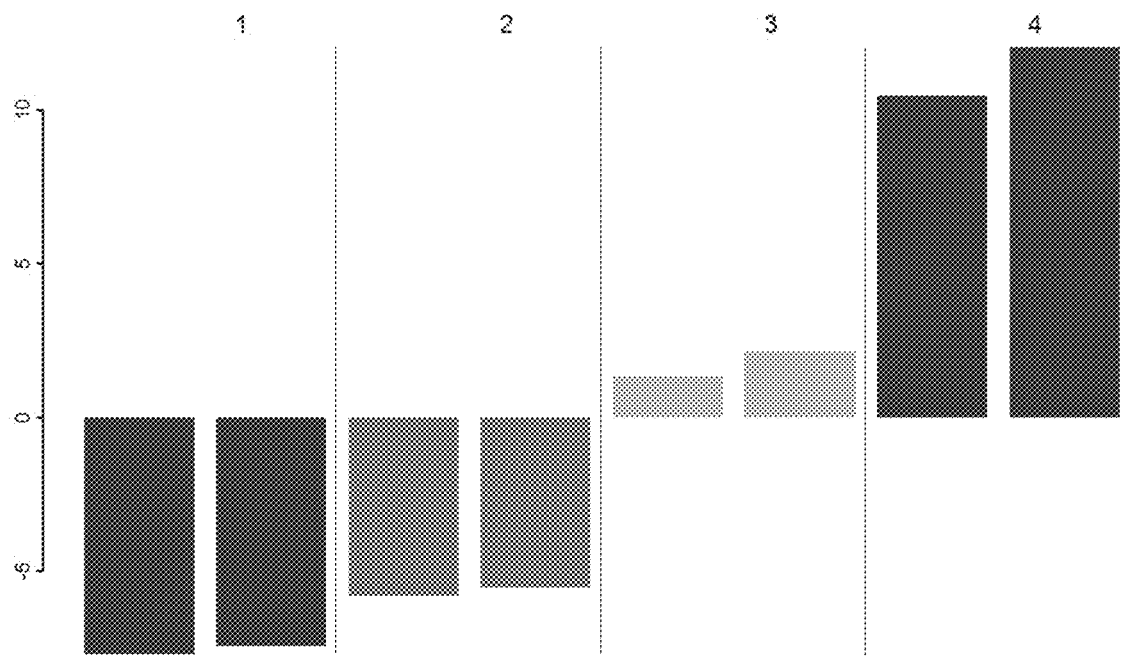
FIG. 32 shows TGF-β pathway activity predictions calculated by the '11-gene list'-Bayesian network in 2D and 3D cultures of A549 tuna adenocarcinoma cell lines stimulated with or without a 10 ng/mL TNF and 2 ng/mL TGF-β

A second example of improved TGF-β pathway activity predictions is found in A549 lung adenocarcinoma cell line samples grown in 2D and 3D cultures stimulated with or without TNF and TGF-β. The model predictions using both the '11-gene' Bayesian network model and the '11-gene list+ SERPINE1' are shown in FIGS. 32 and 33. EMT was only efficiently induced in the 3D culture model with stimulation (group 4). This induction of EMT is diagnosed with a higher accuracy in the '11-gene list+ SERPINE1' model compared to the '11-gene list' model, also in case the relative difference between groups 3 and 4 is considered.

A third example is the TGF-β pathway activity predictions using both models in glioma patients and some control samples from GSE16011. It is known from literature that TGF-β signaling plays a significant role in gliomas (see Kaminska B. et al., "TGF beta signaling and its role in glioma pathogenesis", Advances in Experimental Medicine and Biology, Vol. 986, 2013, pages 171 to 187). The Bayesian network based on '11-gene list+ SERPINE1' improves the separation of passive from active samples compared to the '11-gene list' Bayesian network. In addition, a higher fraction of patients is predicted to have an active TGF-β pathway which is more in line with scientific consensus (see e.g. Kaminska et al.). Moreover, the normal brain samples are predicted to have a passive TGF-β with higher probabilities, which is in agreement with the fact that the TGF-β signaling pathway is expected to be in its tumor-suppressive role or passive role.

The last example demonstrating the improved TGF-β pathway activity predictions by including SERPINE1 in the pathway model is shown by comparing the results of Cox's regression analysis of the 284 glioma patients from GSE16011 using the Bayesian network model based on the '11-gene list+ SERPINE' and '11-gene list'. As shown in FIGS. 34 and 35, the hazard ratio of the probability of TGF-β activity is significantly higher in case the '11-gene list+ SERPINE1' is used: 2.57, $p=7.87e-10$ vs 2.33, $p=3.06e-7$, Training and Using the Mathematical Model Before the mathematical model can be used to infer the activity of the cellular signaling pathway, herein, the TGF-β pathway, in a subject, the model must be appropriately trained.

If the mathematical model is a probabilistic model, e.g., a Bayesian network model, based at least in part on conditional probabilities relating the TGF-β TF element and expression levels of the one or more target gene(s) of the TGF-β pathway measured in the sample of the subject, the training may, for example, be performed as described in detail in the published international patent application WO 2013/011479 A2 ("Assessment of cellular signaling pathway activity using probabilistic modeling of target gene expression").

If the mathematical model is based at least in part on one or more linear combination(s) of expression levels of the one or more target gene(s) of the TGF-β pathway measured in the sample of the subject, the training may, for example, be performed as described in detail in the published international patent application WO 2014/102668 A2 ("Assessment of cellular signaling pathway activity using linear combination(s) of target gene expressions").

Herein, an exemplary Bayesian network model as shown in FIG. 1 was used to model the transcriptional program of the TGF-β pathway in a simple manner. The model consists of three types of nodes: (a) a transcription factor (TF) element (with states "absent" and "present") in a first layer 1; (b) target gene(s) $TG_1$, $TG_2$, $TG_n$ (with states "down" and "up") in a second layer 2, and; (c) measurement nodes linked to the expression levels of the target genes) in a third layer 3. These can be microarray probesets $PS_{1,1}$, $PS_{1,2}$, $PS_{1,3}$, $PS_{2,1}$, $PS_{n,1}$, $PS_{n,m}$ (with states "low" and "high"), as, for example, used herein, but could also be other gene expression measurements such as RNAseq or RT-qPCR.

A suitable implementation of the mathematical model, herein, the exemplary Bayesian network model, is based on microarray data. The model describes (i) how the expression levels of the target gene(s) depend on the activation of the TF element, and (ii) how probeset intensities, in turn, depend on the expression levels of the respective target gene(s). For the latter, probeset intensities may be taken from fRMA pre-processed Affymetrix HG-U133Plus2.0 microarrays, which are widely available from the Gene Expression Omnibus (GEO, ncbi.nlm.nih.gov/geo) and ArrayExpress (ebi.ac.uk/arrayexpress).

As the exemplary Bayesian network model is a simplification of the biology of a cellular signaling pathway, herein, the TGF-β pathway, and as biological measurements are typically noisy, a probabilistic approach was opted for, i.e., the relationships between (i) the TF element and the target gene(s), and (ii) the target gene(s) and their respective probesets, are described in probabilistic terms. Furthermore, it was assumed that the activity of the oncogenic cellular signaling pathway which drives tumor growth is not transiently and dynamically altered, but long term or even irreversibly altered. Therefore the exemplary Bayesian network model was developed for interpretation of a static cellular condition. For this reason complex dynamic cellular signaling pathway features were not incorporated into the model.

Once the exemplary Bayesian network model is built and calibrated (see below), the model can be used on microarray data of a new sample by entering the probeset measurements as observations in the third layer 3, and inferring backwards in the model what the probability must have been for the TF element to be "present". Here, "present" is considered to be the phenomenon that the TF element is bound to the DNA and is controlling transcription of the cellular signaling pathway's target genes, and "absent" the case that the TF element is not controlling transcription. This probability is hence the primary read-out that may be used to indicate activity of the cellular signaling pathway, herein, the TGF-β pathway, which can next be translated into the odds of the cellular signaling pathway being active by taking the ratio of the probability of it being active vs. it being passive (i.e., the odds are given by p/(1−p), where p is the predicted probability of the cellular signaling pathway being active).

In the exemplary Bayesian network model, the probabilistic relations have been made quantitative to allow for a quantitative probabilistic reasoning. In order to improve the generalization behavior across tissue types, the parameters describing the probabilistic relationships between (i) the TF element and the target gene(s) have been carefully hand-picked. If the TF element is "absent", it is most likely that the target gene is "down", hence a probability of 0.95 is chosen for this, and a probability of 0.05 is chosen for the target gene being "up". The latter (non-zero) probability is to account for the (rare) possibility that the target gene is regulated by other factors or that it is accidentally observed as being "up" (e.g. because of measurement noise). If the TF element is "present", then with a probability of 0.70 the target gene is considered "up", and with a probability of 0.30 the target gene is considered "down". The latter values are chosen this way, because there can be several causes why a target gene is not highly expressed even though the TF element is present, e.g., because the gene's promoter region is methylated. In the case that a target gene is not up-regulated by the TF element, but down-regulated, the probabilities are chosen in a similar way, but reflecting the down-regulation upon presence of the TF element. The parameters describing the relationships between (ii) the target gene(s) and their respective probesets have been calibrated on experimental data. For the latter, in this example, microarray data was used from patients samples which are known to have an active TGF-β pathway whereas normal, healthy samples from the same dataset were used as passive TGF-β pathway samples, but this could also be performed using cell line experiments or other patient samples with known cellular signaling pathway activity status. The resulting conditional probability tables are given by:

| A: for upregulated target genes | | |
|---|---|---|
| | $PS_{i,j}$ = low | $PS_{i,j}$ = high |
| $TG_i$ = down | $\dfrac{AL_{i,j} + 1}{AL_{i,j} + AH_{i,j} + 2}$ | $\dfrac{AH_{i,j} + 1}{AL_{i,j} + AH_{i,j} + 2}$ |
| $TG_i$ = up | $\dfrac{PL_{i,j} + 1}{PL_{i,j} + PH_{i,j} + 2}$ | $\dfrac{PH_{i,j} + 1}{PL_{i,j} + PH_{i,j} + 2}$ |

| B: for downregulated target genes | | |
|---|---|---|
| | $PS_{i,j}$ = low | $PS_{i,j}$ = high |
| $TG_i$ = down | $\dfrac{PL_{i,j} + 1}{PL_{i,j} + PH_{i,j} + 2}$ | $\dfrac{PH_{i,j} + 1}{PL_{i,j} + PH_{i,j} + 2}$ |
| $TG_i$ = up | $\dfrac{AL_{i,j} + 1}{AL_{i,j} + AH_{i,j} + 2}$ | $\dfrac{AH_{i,j} + 1}{AL_{i,j} + AH_{i,j} + 2}$ |

In these tables, the variables $AL_{i,j}$, $AH_{i,j}$, $PL_{i,j}$, and $PH_{i,j}$ indicate the number of calibration samples with an "absent" (A) or "present" (P) transcription complex that have a "low" (L) or "high" (H) probeset intensity, respectively. Dummy counts have been added to avoid extreme probabilities of 0 and 1.

To discretize the observed probeset intensities, for each probeset $PS_{i,j}$ a threshold $t_{i,j}$ was used, below which the observation is called "low", and above which it is called "high". This threshold has been chosen to be the (weighted) median intensity of the probeset in the used calibration dataset. Due to the noisiness of microarray data, a fuzzy method was used when comparing an observed probeset intensity to its threshold, by assuming a normal distribution with a standard deviation of 0.25 (on a log 2 scale) around the reported intensity, and determining the probability mass below and above the threshold.

If instead of the exemplary Bayesian network described above, a (pseudo-)linear model as described herein above was employed, the weights indicating the sign and magnitude of the correlation between the nodes and a threshold to call whether a node is either "absent" or "present" would need to be determined before the model could be used to infer cellular signaling pathway activity in a test sample. One could use expert knowledge to fill in the weights and the threshold a priori, but typically the model would be trained using a representative set of training samples, of which, for example, the ground truth is known, e.g., expression data of probesets in samples with a known "present" transcription factor complex (=active cellular signaling pathway) or "absent" transcription factor complex (=passive cellular signaling pathway).

Known in the field are a multitude of training algorithms (e.g., regression) that take into account the model topology and changes the model parameters, here, the weights and the threshold, such that the model output, here, a weighted linear score, is optimized. Alternatively, it is also possible to calculate the weights directly from the expression observed levels without the need of an optimization algorithm.

A first method, named "black and white"-method herein, boils down to a ternary system, in which each weight is an element of the set {−1, 0, 1}. If this is put in a biological context, the −1 and 1 correspond to target genes or probesets that are down- and up-regulated in case of cellular signaling pathway activity, respectively. In case a probeset or target gene cannot be statistically proven to be either up- or down-regulated, it receives a weight of 0. In one example, a left-sided and right-sided, two sample t-test of the expression levels of the active cellular signaling pathway samples versus the expression levels of the samples with a passive cellular signaling pathway can be used to determine whether a probe or gene is up- or down-regulated given the used training data. In cases where the average of the active samples is statistically larger than the passive samples, i.e., the p-value is below a certain threshold, e.g., 0.3, the target gene or probeset is determined to be up-regulated. Conversely, in cases where the average of the active samples is statistically lower than the passive samples, the target gene or probeset is determined to be down-regulated upon activation of the cellular signaling pathway. In case the lowest p-value (left- or right-sided) exceeds the aforementioned threshold, the weight of the target gene or probeset can be defined to be 0.

A second method, named "log odds"-weights herein, is based on the logarithm (e.g., base e) of the odds ratio. The odds ratio for each target gene or probeset is calculated based on the number of positive and negative training samples for which the probeset/target gene level is above and below a corresponding threshold, e.g., the (weighted) median of all training samples. A pseudo-count can be added to circumvent divisions by zero. A further refinement is to count the samples above/below the threshold in a somewhat more probabilistic manner, by assuming that the probeset/target gene levels are e.g. normally distributed around its observed value with a certain specified standard deviation (e.g., 0.25 on a 2-log scale), and counting the probability mass above and below the threshold. Herein an odds ratio calculated in combination with a pseudo-count and using probability masses instead of deterministic measurement values is called a "soft" odds ratio.

Further details regarding the calculating of cellular signaling pathway activity using mathematical modeling of target gene expression can be found in Verhaegh W. et al., "Selection of personalized patient therapy through the use of knowledge-based computational models that identify tumor-driving signal transduction pathways", Cancer Research, Vol. 74, No. 11, 2014, pages 2936 to 2945.

Herein, expression data of human A549 lung adenocarcinoma cell line samples that were either treated with 5 ng/mL TGF-β, resulting in a tumor promoting activity of the TGF-β pathway (from now on referred to as TGF-β active), and a control experiment without TGF-β stimulation, resulting in a tumor suppressing activity of the TGF-β pathway (from now on referred to as TGF-β passive), was used for calibration. These microarrays are publically available under GSE17708 from the gene expression omnibus (GEO, ncbi.nlm.nih.gov/geo/, last accessed Mar. 5, 2014). The samples stimulated with 5 ng/mL TGF-β for 4 hours were chosen as representatives of the active or tumor promoting TGF-β cell lines based on the observed fold change of the selected genes (see Table 1) compared to the unstimulated samples that were chosen as the passive or tumor suppressing TGF-β samples for training. Alternatively, one can use patient samples of primary cells or other cell lines stimulated with and deprived of TGF-β, e.g. GSE6653, GSE42373 and GSE18670 and/or one can use the shortlists of TGF-β target genes (see Tables 2 to 4), (B) PI3K Pathway (i) Selection of Target Genes In the following, Bayesian network models (as exemplary mathematical models) comprising or consisting of direct target genes as direct links between cellular signaling pathway activity and mRNA level, are exemplified, however the distinction between direct and indirect target genes is not always evident. Herein, a method to select direct target genes using a scoring function based on available scientific literature data is presented. Nonetheless, an accidental selection of indirect target genes cannot be ruled out due to limited information as well as biological variations and uncertainties. In order to select the target genes, two repositories of currently available scientific literature were employed to generate two lists of target genes.

The first list of target genes was generated based on scientific literature retrieved from the MEDLINE database of the National Institute of Health accessible at "ncbi.nlm.nih.gov/pubmed" and herein further referred to as "Pubmed". Publications containing putative FOXO target genes were searched for by using queries such as (FOXO AND "target gene") in the period of the first quarter of 2013. The resulting publications were further analyzed manually following the methodology described in more detail below.

Specific cellular signaling pathway mRNA target genes were selected from the scientific literature, by using a ranking system in which scientific evidence for a specific target gene was given a rating, depending on the type of scientific experiments in which the evidence was accumulated. While some experimental evidence is merely suggestive of a gene being a target gene, like for example an mRNA increasing on an microarray of an cell line in which it is known that the PI3K cellular signaling axis is active, other evidence can be very strong, like the combination of an identified cellular signaling pathwayTF binding site and retrieval of this site in a chromatin immunoprecipitation (ChIP) assay after stimulation of the specific cellular signaling pathway in the cell and increase in mRNA after specific stimulation of the cellular signaling pathway in a cell line.

Several types of experiments to find specific cellular signaling pathway target genes can be identified in the scientific literature:

1. ChIP experiments in which direct binding of a cellular signaling pathway-TF to its binding site on the genome is shown. Example: By using chromatin immunoprecipitation (ChIP) technology subsequently putative functional FOXO TF binding sites in the DNA of cell lines with and without active induction of the PI3K pathway were identified, as a subset of the binding sites recognized purely based on nucleotide sequence. Putative functionality was identified as ChIP-derived evidence that the TF was found to bind to the DNA binding site.

2. Electrophoretic Mobility Shift (EMSA) assays which show in vitro binding of a TF to a fragment of DNA containing the binding sequence. Compared to CUP-based evidence EMSA-based evidence is less strong, since it cannot be translated to the in vivo situation.

3. Stimulation of the cellular signaling pathway and measuring mRNA profiles on a microarray or using RNA sequencing, using cellular signaling pathway-inducible cell lines and measuring mRNA profiles measured several time points after induction in the presence of cycloheximide, which inhibits translation to protein, thus the induced mRNAs are assumed to be direct target genes.

4. Similar to 3, but using quantitative PCR to measure the amounts of mRNAs.

5. Identification of TF binding sites in the genome using a bioinformatics approach. Example for the FOXO TF element: Using the conserved FOXO binding motif 5'-TTGTTTAC-3', a software program was run on the human genome sequence, and potential binding sites were identified, both in gene promoter regions and in other genomic regions.

6. Similar as 3, only in the absence of cycloheximide.

7. Similar to 4, only in the absence of cycloheximide.

8. mRNA expression profiling of specific tissue or cell samples of which it is known that the cellular signaling pathway is active, however in absence of the proper negative control condition.

In the simplest form one can give every potential target mRNA 1 point for each of these experimental approaches in which the target mRNA was identified.

Alternatively, points can be given incrementally, meaning one technology one point, a second technology adds a second point, and so on. Using this relatively simple ranking strategy, one can snake a list of most reliable target genes.

Alternatively, ranking in another way can be used to identify the target genes that are most likely to be direct target genes, by giving a higher number of points to the technology that provides most evidence for an in vivo direct target gene, in the list above this would mean 8 points for experimental approach 1), 7 for 2), and going down to 1 point for experimental approach 8). Such a list may be called a "general target gene list".

Despite the biological variations and uncertainties, the inventors assumed that the direct target genes are the most likely to be induced in a tissue-independent manner. A list of these target genes may be called an "evidence curated list of target genes". Such an evidence curated list of target genes has been used to construct computational models of the PI3K pathway that can be applied to samples coming from different tissue sources.

The following will illustrate exemplary how the selection of an evidence curated target gene list specifically was constructed for the PI3K pathway.

For the purpose of selecting PI3K target genes used as input for the "model", the following three criteria were used:

1. Gene promoter/enhancer region contains a FOXO binding motif:
   a. The FOXO binding motif should be proven to respond to an activity of the PI3K pathway, e.g., by means of a transient transfection assay in which the specific FOXO motif is linked to a reporter gene, and
   b. The presence of the FOXO motif should be confirmed by, e.g., an enriched motif analysis of the gene promoter/enhancer region.
2. FOXO (differentially) binds in vivo to the promoter/enhancer region of the gene in question, demonstrated by, e.g., a ChIP/CHIP experiment or another chromatin immunoprecipitation technique:
   a. FOXO is proven to bind to the promoter/enhancer region of the gene when the PI3K pathway is not active, and
   b. (preferably) does not bind (or weakly binds) to the gene promoter/enhancer region of the gene when the PI3K pathway is active.
3. The gene is differentially transcribed when the activity of the PI3K pathway is changed, demonstrated by, e.g.,
   a. fold enrichment of the mRNA of the gene in question through a time PCR, or microarray experiment, or
   b. the demonstration that RNA Pol 11 binds to the promoter region of the gene through an immunoprecipitation assay.

The selection was performed by defining as target genes of the PI3K pathway the genes for which enough and well documented experimental evidence was gathered proving that all three criteria mentioned above were met. A suitable experiment for collecting evidence of PI3K differential binding is to compare the results of, e.g., a ChIP-Seq experiment in a cancer cell line that expresses activity of the PI3K, pathway in response to tamoxifen (e.g., a cell line transfected with a tamoxifen-inducible FOXO construct, such as FOXO.A3.ER), when exposed or not exposed to tamoxifen. The same holds for collecting evidence of mRNA transcription.

The foregoing discusses the generic approach and a more specific example of the target gene selection procedure that has been employed to select a number of target genes based upon the evidence found using the above mentioned approach. The lists of target genes used in the Bayesian network models for the PI3K pathway is shown in Table 9.

TABLE 9

"Evidence curated list of target genes" of the PI3K pathway used in the Bayesian network models and associated probesets used to measure the mRNA expression level of the target genes.

| Target gene | Probeset |
| --- | --- |
| ATP8A1 | 1569773_at |
| | 210192_at |
| | 213106_at |
| BCL2L11 | 1553088_a_at |
| | 1553096_s_at |
| | 1555372_at |
| | 1558143_a_at |
| | 208536_s_at |
| | 222343_at |
| | 225606_at |
| BNIP3 | 201848_s_at |
| | 201849_at |
| BTG1 | 1559975_at |
| | 200920_s_at |
| | 200921_s_at |
| C10orf10 | 209182_s_at |
| | 209183_s_at |
| CAT | 201432_at |
| | 211922_s_at |
| | 215573_at |
| CBLB | 208348_s_at |
| | 209682_at |
| CCND1 | 208711_s_at |
| | 208712_at |
| | 214019_at |
| CCND2 | 200951_s_at |
| | 200952_s_at |
| | 200953_s_at |
| | 231259_s_at |
| | 1555056_at |
| | 202769_at |
| | 202770_s_at |
| | 211559_s_at |
| CDKN1B | 209112_at |
| DDB1 | 208619_at |
| DYRK2 | 202968_s_at |
| | 202969_at |
| | 202970_at |
| | 202971_s_at |
| ERBB3 | 1563252_at |
| | 1563253_s_at |
| | 202454_s_at |
| | 215638_at |
| | 226213_at |
| EREG | 1569583_at |
| | 205767_at |
| ESR1 | 205225_at |
| | 211233_x_at |
| | 211234_x_at |
| | 211235_s_at |
| | 211627_x_at |
| | 215551_at |
| | 215552_s_at |
| | 217190_x_at |
| | 207672_at |
| EXT1 | 201995_at |
| FASLG | 210865_at |
| | 211333_s_at |
| FGFR2 | 203638_s_at |
| | 203639_s_at |
| | 208225_at |
| | 208228_s_at |
| | 208229_at |
| | 208234_x_at |
| | 211398_at |
| | 211399_at |
| | 211400_at |
| | 211401_s_at |
| | 240913_at |

TABLE 9-continued

"Evidence curated list of target genes" of the PI3K pathway used in the Bayesian network models and associated probesets used to measure the mRNA expression level of the target genes.

| Target gene | Probeset |
| --- | --- |
| GADD45A | 203725_at |
| IGF1R | 203627_at |
|  | 203628_at |
|  | 208441_at |
|  | 225330_at |
|  | 243358_at |
| IGFBP1 | 205302_at |
| IGFBP3 | 210095_s_at |
|  | 212143_s_at |
| INSR | 207851_s_at |
|  | 213792_s_at |
|  | 226212_s_at |
|  | 226216_at |
|  | 226450_at |
| LGMN | 201212_at |
| MXI1 | 202364_at |
| PPM1D | 204566_at |
|  | 230330_at |
| SEMA3C | 203788_s_at |
|  | 203789_s_at |
| SEPP1 | 201427_s_at |
|  | 231669_at |
| SESN1 | 218346_s_at |
| SLC5A3 | 1553313_s_at |
|  | 212944_at |
|  | 213167_s_at |
|  | 213164_at |
| SMAD4 | 1565702_at |
|  | 1565703_at |
|  | 202526_at |
|  | 202527_s_at |
|  | 235725_at |
| SOD2 | 215078_at |
|  | 215223_s_at |
|  | 216841_s_at |
|  | 221477_s_at |
| TLE4 | 204872_at |
|  | 214688_at |
|  | 216997_x_at |
|  | 233575_s_at |
|  | 235765_at |
| TNFSF10 | 202687_s_at |
|  | 202688_at |
|  | 214329_x_at |

The second list of target genes was generated using the manually-curated database of scientific publications provided within Thomson-Reuters' Metacore (last accessed May 14, 2013). The database was queried for genes that are transcriptionally regulated directly downstream of the family of human FOXO transcription factors (i.e., FOXO1, FOXO3A, FOXO4 and FOXO6). This query resulted in 336 putative FOXO target genes that were further analyzed as follows. First all putative FOXO target genes that only had one supporting publication were pruned. Next a scoring function was introduced that gave a point for each type of experimental evidence, such as ChIP, EMSA, differential expression, knock down/out, luciferase gene reporter assay, sequence analysis, that was reported in a publication. The same experimental evidence is sometimes mentioned in multiple publications resulting in a corresponding number of points, e.g., two publications mentioning a ChIP finding results in twice the score that is given for a single ChIP finding. Further analysis was performed to allow only for genes that had diverse types of experimental evidence and not only one type of experimental evidence, e.g., differential expression. Finally, an evidence score was calculated for all putative FOXO target genes and all putative FOXO target genes with an evidence score of 6 or more were selected (shown in Table 10). The cut-off level of 6 was chosen heuristically as it was previously shown that approximately 30 target genes suffice largely to determine pathway activity.

A list of these target genes may be called a "database-based list of target genes". Such a curated target gene list has been used to construct computational models that can be applied to samples coining from different tissue sources.

TABLE 10

"Database-based list of target genes" of the PI3K pathway used in the Bayesian network models and associated probesets used to measure the mRNA expression level of the target genes.

| Target gene | Probeset |
| --- | --- |
| AGRP | 207193_at |
| ATG14 | 204568_at |
| BCL2L11 | 1553088_a_at |
|  | 1553096_s_at |
|  | 1555372_at |
|  | 1558143_a_at |
|  | 208536_s_at |
|  | 222343_at |
|  | 225606_at |
| BCL6 | 203140_at |
|  | 215990_s_at |
| BIRC5 | 202094_at |
|  | 202095_s_at |
|  | 210334_x_at |
| BNIP3 | 201848_s_at |
|  | 201849_at |
| CAT | 201432_at |
|  | 211922_s_at |
|  | 215573_at |
| CAV1 | 203065_s_at |
|  | 212097_at |
| CCNG2 | 1555056_at |
|  | 202769_at |
|  | 202770_s_at |
|  | 211559_s_at |
|  | 228081_at |
| CDKN1A | 1555186_at |
|  | 202284_s_at |
| CDKN1B | 209112_at |
| FASLG | 210865_at |
|  | 211333_s_at |
| FBXO32 | 225801_at |
|  | 225803_at |
|  | 225345_s_at |
|  | 225328_at |
| GADD45A | 203725_at |
| IGFBP1 | 205302_at |
| KLF2 | 219371_s_at |
|  | 226646_at |
| KLF4 | 220266_s_at |
|  | 221841_s_at |
| MYOD1 | 206656_s_at |
|  | 206657_s_at |
| NOS3 | 205581_s_at |
| PCK1 | 208383_s_at |
| PDK4 | 1562321_at |
|  | 205960_at |
|  | 225207_at |
| POMC | 205720_at |
| PPARGC1A | 1569141_a_at |
|  | 219195_at |
| PRDX3 | 201619_at |
|  | 209766_at |
| RAG1 | 1554994_at |
|  | 206591_at |
| RAG2 | 215117_at |
| RBL2 | 212331_at |
|  | 212332_at |

TABLE 10-continued

"Database-based list of target genes" of the PI3K pathway used in the Bayesian network models and associated probesets used to measure the mRNA expression level of the target genes.

| Target gene | Probeset |
|---|---|
| SESN1 | 218346_s_at |
| SIRT1 | 218878_s_at |
| SOD2 | 215078_at |
|  | 215223_s_at |
|  | 216841_s_at |
|  | 221477_s_at |
| STK11 | 204292_x_at |
|  | 231017_at |
|  | 41657_at |
| TNFSF10 | 202687_s_at |
|  | 202688_at |
|  | 214329_x_at |
| TXNIP | 201008_s_at |
|  | 201009_s_at |
|  | 201010_s_at |

The third list of target genes was venerated on the basis of the two aforementioned lists, i.e., the evidence curated list (see Table 9) and the database-based list (see Table 10). Three criteria have been used to further select genes from these two lists. The first criterion is related to the function attributed to the target genes. Functions attributed to genes can be found in scientific literature, but are often available in public databases such as the OMIM database of the NIH (accessible via "ncbi.nlm.nih.gov/omim"). Target genes from the evidence curated list in Table 9 and the database-based list in Table 10 that were found to be attributed to be involved in processes essential to cancer, such as apoptosis, cell cycle, tumor suppression/progression, DNA repair, differentiation, were selected in the third list. Lastly, target genes that were found to have a high differential expression in cell line experiments with known high PI3K low FOXO activity versus known low PI3K/high FOXO activity were selected. Herein, target genes that had a minimum expression difference of 2" (herein: on a probeset level) between the "on" and "off" state of FOXO transcription averaged over multiple samples were included in the third list. The third criterion was especially aimed at selecting the most discriminative target genes. Based on the expression levels in cell line experiments with multiple samples with known high PI3K/low FOXO activity and multiple samples with known low PI3K/high FOXO activity, an odds ratio (OR) was calculated. Herein, the odds ratio was calculated per probeset using the median value as a cut-off and a soft boundary representing uncertainty in the measurement. Target genes from the evidence curated list and the database-based list were ranked according to the "soft" odds ratio and the highest ranked (OR>2) and lowest ranked (OR<½, i.e., negatively regulated target genes) target genes were selected for the third list of target genes.

Taking into account the function of the gene, the differential expression in "on" versus "off" signaling and a higher odds ratio, a set of target genes was found (shown in Table 11) that was considered to be more probative in determining the activity of the PI3K signaling pathway. Such a list of target genes may be called a "shortlist of target genes". Hence, in one embodiment, the target genes reported in Table 11 are useful according to the present disclosure. Nonetheless, given the relative ease with which acquisition technology such as microarrays can acquire expression levels for large sets of genes, it is contemplated to utilize some or all of the target genes of Table 11, and optionally additionally use on, two, some, or all of the remaining target genes of Table 9 and Table 10. In addition, a "12 target genes shortlist" of target genes of the PI3K pathway was generated as described in this Example above for TGF-β target genes.

TABLE 11

"Shortlist of target genes" of the PI3K pathway based on the evidence curated list of target genes and the database-based list of target genes.

| Target gene |
|---|
| AGRP |
| BCL2L11 |
| BCL6 |
| BNIP3 |
| BTG1 |
| CAT |
| CAV1 |
| CCND1 |
| CCND2 |
| CCNG2 |
| CDKN1A |
| CDKN1B |
| ESR1 |
| FASLG |
| FBXO32 |
| GADD45A |
| INSR |
| MXI1 |
| NOS3 |
| PCK1 |
| POMC |
| PPARGC1A |
| PRDX3 |
| RBL2 |
| SOD2 |
| TNFSF10 |

TABLE 12

"12 target genes shortlist" of target genes of the PI3K pathway based on the evidence curated list of target genes.

| Target gene |
|---|
| FBXO32 |
| BCL2L11 |
| SOD2 |
| TNFSF10 |
| BCL6 |
| BTG1 |
| CCNG2 |
| CDKN1B |
| BNIP3 |
| GADD45A |
| INSR |
| MXI1 |

(ii) Training and Using the Mathematical Model

The above description regarding the training and the use of the mathematical model of the TGF-β pathway also applies to the training and the use of the mathematical model of the PI3K pathway.

Herein, publically available data on the expression of a HUVEC cell line with a stable transfection of a FOXO construct that is inducible upon stimulation with 4OHT (GSE16573 available from the Gene Expression Omnibus, last accessed. Oct. 6, 2014) was used as an example to train the PI3K pathway model. The cell lines with the inducible FOXO construct that were stimulated for 12 hours with 4OHT were considered as the FOXO active samples (n=3), whereas the passive FOXO samples were the cell lines with the construct without 4OHT stimulation (n=3).

(C) Wnt Pathway

The selection of target genes of the Wnt pathway was previously described in WO 2013/011479 A2 and WO 2014/102668 A2. The "Evidence curated list of target genes" for the Wnt pathway was used as described in this Example above for TGF-β target genes in order to generate the "Shortlist of target genes" for the Wnt pathway and the "12 target genes shortlist" of target genes of the Wnt pathway.

TABLE 13

"Evidence curated list of target genes" of the Wnt pathway used in the Bayesian network models and associated probesets used to measure the mRNA expression level of the target genes.
Target gene ADRA2C
ASCL2
AXIN2
BMP7
CCND1
CD44
COL18A1
DEFA6
DKK1
EPHB2
EPHB3
FAT1
FZD7
GLUL
HNF1A
IL8
KIAA1199
KLF6
LECT2
LEF1
LGR5
MYC
NKD1
OAT
PPARG
REG1B
RNF43
SLC1A2
SOX9
SP5
TBX3
TCF7L2
TDGF1
ZNRF3

TABLE 14

"Shortlist of target genes" of the Wnt pathway based on the evidence curated list of target genes.
Target gene KIAA1199
AXIN2
CD44
RNF43
MYC
TBX3
TDGF1
SOX9
ASCL2
IL8
SP5
ZNRF3
EPHB2
LGR5
EPHB3
KLF6
CCND1
DEFA6
FZD7

TABLE 15

"12 target genes shortlist" of target genes of the Wnt pathway based on the evidence curated list of target genes.
Target gene AXIN2
CD44
LGR5
CEMIP
(KIAA1199)
MYC
CXCL8 (IL8)
SOX9
EPHB3
RNF43
TDGF1
ZNRF3
DEFA6

(D) ER Pathway

Please note that with respect to WO 2013/011479 A2 and WO 2014/102668 A2, herein, the rank order of the ER target genes is slightly changed because new literature evidence was added. The ER target genes were selected and ranked in a similar way as described in Example 3 of WO 2014/102668 A2. The genes were ranked by combining the literature evidence score and the individual ability of each gene to differentiate between an active and inactive pathway within the model. This ranking was based on a linear combination of weighted false positive and false negative rates obtained for each gene when training the model with a training set of MCF7 cell line samples, which were depleted of estrogen and subsequently remained depleted or were exposed to 1 nM estrogen for 24 hours (GSE35428), and testing the model with the training set and two other training sets in which MCF7 cells were depleted of estrogen and subsequently remained depleted or were exposed to 10 nM or 25 nM estrogen (GSE11352 and GSE8597, respectively).

(Note that a combination of weighted false positives and false negatives (instead of odds ratios) was used to account for the different experimental conditions used in the various sets. The different weights were set according with the inventor's confidence that the false positives (negatives) were a consequence of the model and not of the different experimental condition the sample had been subjected to. For example, in all experiments the MCF7 cell line samples were first depleted of estrogen for a period of time before being exposed to estrogen or further depleted for another 24 hours. A shorter depletion time could cause the pathway to still be active despite the estrogen depletion, in this case a false positive would have less weight than when both the test and training samples were depleted for the same amount of time.

Based on additional literature review and the examination of the magnitude of differential expression between active and inactive samples as discussed in more detail below, PDZK1 was selected as a direct target gene of the ER pathway. After manually evaluating the additional scientific papers for experimental evidence of putative target genes of the ER pathway using an analogous methodology as described in Example 1 (for TGF-β and PI3K), a number of additional putative ER target genes were identified.

Putative ER target genes were analyzed for the presence of a gene promoter/enhancer region containing an estrogen response element (ERE) motif. The ERE motif should be proven to respond to estrogen, e.g., by means of a transient transfection assay in which the specific ERE motif is linked to a reporter gene. The presence of the ERE motif should be confirmed by, e.g., an enriched motif analysis of the gene promoter/enhancer region. In addition, ER (differentially) binds in vivo to the promoter/enhancer region of the gene in question, demonstrated by, e.g. a ChIP/CHIP experiment or a chromatin immunoprecipitation assay. For example, ER should be proven to bind to the promoter/enhancer region of the gene when the ER pathway is active, and, for example, does not bind (or weakly binds) to the gene promoter/enhancer region of the gene if the ER pathway is not active. Finally, the gene is differentially transcribed when the ER pathway is active, demonstrated by, e.g., fold enrichment of the mRNA of the gene in question through real time PCR, or microarray experiment, or the demonstration that RNA Pol II binds to the promoter region of the gene through an immunoprecipitation assay.

The selection was done by defining as ER target genes the genes for which enough and well documented experimental evidence was gathered from literature proving that all three criteria mentioned above were met. A suitable experiment for collecting evidence of ER differential binding is to compare the results of, e.g., a ChIP/CHIP experiment in a cancer cell line that responds to estrogen (e.g., the MCF-7 cell line), when exposed or not exposed to estrogen. After evaluating all additional scientific papers, a new ranking for all putative target genes was based on the strength of experimental evidence found in the literature. Consequently, one putative ER target gene, PDZK1, achieved an experimental evidence score above the set threshold. Therefore, PDZK1 was considered to be a bona fide direct target gene of the ER pathway.

In the original selection of ER target genes, only the capacity of differentiating active vs. inactive samples, calculated using the 'soft' odds ratio, was considered. In the current analysis, the magnitude of differential expression was also included in the evaluation. Since the magnitude of differential expression signal is next to the 'soft' odds ratio as an important feature of a well-designed assay, this new selection method is anticipated to be an improvement over the original criteria. Differential gene expression magnitude was estimated by averaging the difference of mean gene expression between ER active (on) samples and ER inactive (off) samples on a selection of Affymetrix HG1133Plus2 data sets, namely GSE35427, GSE11352, GSE21618, GSE8597 and two in-house generated datasets including multiple breast cancer cell lines stimulated with estradiol (E2) or a control. Mean gene expression was computed separately for each Affymetrix probeset related to the gene for each dataset. Only probesets that were significantly differentially expressed were taken into account in the average. The average differential expression between samples stimulated with estradiol, i.e. ER active samples, and control/unstimulated samples, i.e. ER passive samples, of PDZK1 was 2.08. This differential expression is exceptionally high (average over all up-regulated gens is 0.88) and is comparable to the target genes with the highest differential expression, e.g. PGR with an average differential expression of 2.14. In addition, the 'soft' odds ratio of PDZK1 (average 26.6) is also higher than average (19.03).

In the following examples we compare the original 13 ER target gene list (GREB1, PGR, XBP1, CA12, SOD1, CTSD, IGFBP4, TFF1, SGK3, NRIP1, CELSR2, WISP2, and AP1B1) model (hereafter called short list model) to a new 14 ER target gene model constructed using PDZK1 and the original 13 ER target gene list (hereafter called short list-f-PDZK1 model). Both Bayesian network models were trained in the exact same way (using the Affymetrix HGU133Plus2 GSE8597 dataset) with the only difference being the list of ER target genes.

In one example, the ER pathway activity was computed for a selection of Affymetrix HGU133Plus2 datasets that exemplify typical breast cancer and normal breast tissue samples (public datasets GSE12276, GSE10870, and GSE21653) containing 256 ER positive breast cancer samples, 195 ER negative breast cancer samples, 27 normal breast tissue samples, and 94 unknown ER status breast cancer samples. While the ER pathway is expected to be inactive in ER negative breast cancer and normal breast, about 50 to 70% of ER positive breast cancers are expected to be active, based on response to hormone therapy data. The proportion of ER positive breast cancer samples predicted to be active by the short list model (74%) and by the short list+ PDZK1 model (73%) is comparable and similar to the proportion of ER positive cancer patients to respond to Hormone therapy. Furthermore, the average of the probability of ER activation, over all ER positive samples, computed by the short list+ PDZK1 (average log 2 odds ratio: 2.73) list model is slightly higher that the average probability of activation predicted by the short list model (average log 2 odds ratio: 2.70, with a difference of 0.03 in the log 2 odds ratio scale) making them comparable for this type of sample. An unexpected beneficial technical effect of including PDZK1 occurs when analyzing ER negative breast cancer and normal tissue samples: the average of the probability of ER activation computed by the short list+ PDZK1 list model (average log 2 odds ratio: −7.3) is considerably lower than the average probability of activation predicted by the short list model (average log 2 odds ratio: 6.8, with a difference of 0.5 in the log 2 odds ratio scale, Wilcoxon rank test 2-sided pv=0.02), making the short list+ PDZK1 model technically better than the short model in this situation. Furthermore, this improvement is more than a minute scaling of the predicted pathway activity levels which is anticipated in case one more target genes is added to the model, therefore the addition of PDZK1 renders an unexpected, advantageous technical effect.

In another example, the ER pathway activity was computed for public Affymetrix HGU133Plus2 datasets GSE8597, GSE35428, GSE11352, that exemplify experiments where estrogen sensitive breast cell lines (in this case MCF7) are exposed to or deprived of estrogen stimulation. It is well known that exposure the estrogen activates the ER pathway in MCF7 cell lines and deprivation of estrogen shuts the ER pathway down in MCF7 cell lines. Also, in this case the short list+ PDZK1 model seems to be technically superior to the short list model, both for the case where MCF7 cell lines are exposed to estrogen, where the predicted activity computed by the short list+ PDKZ1 model (average log 2 odds ratio: 14.7) is higher than predicted activity computed by the short list model (average log 2 odds ratio: 14.0, a difference of 0.7 on the log 2 odds ratio scale). The predicted activity computed for all samples deprived of estrogen stimulation by the short list+ PDKZ1 model (average log 2 odds ratio: −7.7) is lower than predicted activity computed by the short list model rage log 2 odds ratio: −7.3, a difference of 0.4 on the log 2 odds ratio scale) for 85% of the 27 samples that were deprived of estrogen. Also this improvement is more than a minute scaling of the predicted pathway activity levels which is anticipated in case one more target genes is added to the model, therefore the addition of PDZK1 renders an unexpected, advantageous technical effect.

To probe the effect of the new gene in PCR assays, in the following examples we compare a 11 ER target gene list (GREB1, PGR, XBP1, CA12, SOD1, CTSD, IGFBP4, TFF1, SGK3, NRIP1, CELSR2, ERBB2, and ESR1) model (hereafter called PCR list model) to a new 12 ER target gene model constructed using PDZK1 and the above mentioned 11 ER target gene list (hereafter called PCR list-(PDZK1 model). Both Bayesian network models were trained in exactly the same way (using a gene expression data generated by RT-qPCR, from an in-house estrogen deprivation/stimulation experiment in MCF7 cell lines) with the only difference being the addition of the PDZK1 ER target gene in the PCR list+ PDZK1 model. The ER pathway activity was computed for a total of 12 samples: 6 deprived from estrogen and 6 stimulated with estrogen. Here again the model containing PDZK1 (PCR list PDZK1 model) seems to be technically superior to the model without PDZK1 (PCR list model), both for the case of exposed to estrogen, where the predicted activity computed by the PCR list+ PDKZ1 model (average log 2 odds ratio: 4.7) is higher than predicted activity computed by the PCR list model (average log 2 odds ratio: 3.9, a difference of 0.8 on the log 2 odds ratio scale). The predicted activity for the estrogen deprived samples computed by the PCR list+ PDKZ1 model (average log 2 odds ratio: −5.1) is lower than predicted activity computed by the short list model (average log 2 odds ratio: −4.5, a difference of 0.6 on the log 2 odds ratio scale). This difference is very important in models that use a small amount of "probes" to measure the sample ER target gene profile, since they usually have less discrimination power (note the low average predicted activities). In conclusion, this improvement is more than a minute scaling of the predicted pathway activity levels which is anticipated in case one more target genes is added to the model, therefore the addition of PDZK1 renders an unexpected, advantageous technical effect.

As discussed above, the selection of target genes of the ER pathway was previously, described in WO 2013/011479 A2 and WO 2014/102668 A2. The "Evidence curated list of target genes" for the HH pathway was used as described in this Example above for TGF-β target genes in order to generate the "Shortlist of target genes" for the HH pathway and the "12 target genes shortlist" of target genes of the HH pathway, based on the additional literature review and inclusion of the PDZK1 target gene.

TABLE 16

"Evidence curated list of target genes" of the ER pathway
used in the Bayesian network models and associated probesets
used to measure the mRNA expression level of the target genes.
Target gene AP1B1
ATP5J
COL18A1
COX7A2L
CTSD
DSCAM
EBAG9
ESR1
HSPB1
KRT19
NDUFV3
NRIP1
PGR
PISD
PRDM15
PTMA
RARA
SOD1
TFF1
TRIM25
XBP1
GREB1

TABLE 16-continued

"Evidence curated list of target genes" of the ER pathway
used in the Bayesian network models and associated probesets
used to measure the mRNA expression level of the target genes.
Target gene

IGFBP4
MYC
SGK3
WISP2
ERBB2
CA12
CDH26
CELSR2

TABLE 17

"Shortlist of target genes" of the ER pathway based
on the evidence curated list of target genes.
Target gene CDH26
SGK3
PGR
GREB1
CA12
XBP1
CELSR2
WISP2
DSCAM
ERBB2
CTSD
TFF1
NRIP1
PDZK1
IGFBP4
ESR1
SOD1
AP1B1

TABLE 18

"12 target genes shortlist" of target genes of the ER
pathway based on the evidence curated list of target genes.
Target gene

TFF1
GREB1
PGR
SGK3
PDZK1
IGFBP4
NRIP1
CA12
XBP1
ERBB2
ESR1
CELSR2

(E) HH Pathway

The selection of target genes of the HH pathway was previously described in WO 2013/011479 A2 and WO 2014/102668 A2. The "Evidence curated list of target genes" for the HH pathway was used as described in this Example above for TGF-β target genes in order to generate the "Shortlist of target genes" for the HH pathway and the "12 target genes shortlist" of target genes of the HH pathway.

TABLE 19

"Evidence curated list of target genes" of the HH pathway used in the Bayesian network models and associated probesets used to measure the mRNA expression level of the target genes.
Target gene GLI1
PTCH1
PTCH2
HHIP
SPP1
TSC22D1
CCND2
H19
IGFBP6
TOM1
JUP
FOXA2
MYCN
NKX2_2
NKX2_8
RAB34
MIF
GLI3
FST
BCL2
CTSL1
TCEA2
MYLK
FYN
PITRM1
CFLAR
IL1R2
S100A7
S100A9
CCND1
JAG2
FOXM1
FOXF1
FOXL1

TABLE 20

"Shortlist of target genes" of the HH pathway based on the evidence curated list of target genes.
Target gene GLI1
PTCH1
PTCH2
IGFBP6
SPP1
CCND2
FST
FOXL1
CFLAR
TSC22D1
RAB34
S100A9
S100A7
MYCN
FOXM1
GLI3
TCEA2
FYN
CTSL1

TABLE 21

"12 target genes shortlist" of target genes of the HH pathway based on the evidence curated list of target genes.
Target gene

GLI1
PTCH1
PTCH2

TABLE 21-continued

"12 target genes shortlist" of target genes of the HH pathway based on the evidence curated list of target genes.
Target gene

CCND2
IGFBP6
MYCN
FST
RAB34
GLI3
CFLAR
S100A7
S100A9

Example 2: Determining Risk Score

In general, many different formulas can be devised for determining a risk score that indicates a risk that a subject will experience a clinical event within a certain period of time and that is based at least in part on a combination of inferred activities of two or more cellular signaling pathways in a subject, i.e.:

$$MPS = F(P_i) + X, \text{ with } i=1 \ldots N, \quad (3)$$

wherein MPS denotes the risk score (the term "MPS" is used herein as an abbreviation for "Multi-Pathway Score" in order to denote that the risk score is influenced by the inferred activities of two or more cellular signaling pathways), $P_i$ denotes the activity of cellular signaling pathway i, N denotes the total number of cellular signaling pathways used for calculating the risk score, and X is a place holder for possible further factors and/or parameters that may go into the equation. Such a formula may be more specifically a polynomial of a certain degree in the given variables, or a linear combination of the variables. The weighting coefficients and powers in such a polynomial may be set based on expert knowledge, but typically a training data set with known ground truth, e.g., survival data, is used to obtain estimates for the weighting coefficients and powers of Eq. (3). The inferred activities are combined using Eq. (3) and will subsequently generate an MPS. Next, the weighting coefficients and powers of the scoring function are optimized such that a high MPS correlates with a higher probability that the patient will experience the clinical event, and vice versa. Optimizing the scoring function's correlation with survival data can be done using a multitude of analysis techniques, e.g., a Cox proportional hazards test (as exemplified herein), a log-rank test, a Kaplan-Meier estimator in conjunction with standard optimization techniques, such as gradient-descent or manual adaptation, and so on.

In their experiments, the inventors found no reason to anticipate a power law response between the activities of the cellular signaling pathways and the recurrence risk, hence Eq. (3) can be simplified:

$$MPS = w_1 \cdot P_1 + w_2 \cdot P_2 + \ldots + w_N \cdot P_N + X, \quad (4)$$

wherein denote weighting coefficients.

In this example, the clinical event is cancer, in particular, breast cancer, and the inferred activities of the TGF-β pathway, the PI3K pathway, the Wnt pathway, the ER pathway, the HH pathway are considered, as discussed in detail herein as well as in the published international patent application WO 2013/011479 A2 ("Assessment of cellular signaling pathway activity using probabilistic modeling of target gene expression") and/or in the published international patent application WO 2014/102668 A2 ("Assessment of cellular signaling pathway activity using linear combination(s) of target gene expressions").

The formulas that are exemplified herein take into account the activities of the TGF-β pathway and one or more of the PI3K, pathway, the Wnt pathway, the ER pathway, and the HH pathway. These formulas are based on the inventors' observations derived from cancer biology research as well as from correlations discovered by the inventors in publically available datasets between survival and the activities of the TGF-β pathway, the PI3K pathway, the Wnt pathway, the ER pathway, and the HH pathway. Early developmental pathways, like the Wnt pathway and the HH pathway, are thought to play a role in metastasis caused by cancer cells which have reverted to a more stem cell like phenotype, called cancer stem cells. Indeed, the inventors' believe that sufficient indications are available for the early developmental pathways, such as the Wnt pathway, to play a role in cancer metastasis, enabling metastatic cancer cells to start dividing in the seeding location into another organ or tissue. Metastasis is associated with worse prognosis and represents a form of cancer recurrence, thus activity of early developmental pathways, such as the Wnt pathway and the HH pathway, in cancer cells is expected by the inventors to be predictive for worse prognosis. The presumed role of the Wnt pathway and the I-III pathway in cancer progression and metastasis is based on pre-clinical research, and has not been shown in subjects, since no methods for measuring their activity have been available. In addition, the inventors discovered sufficient indications in publically available datasets that show a correlation between activity of the ER pathway being a (relatively) protective mechanism for survival and activity of the TGF-β pathway and the PI3K pathway, which is correlated with worse prognosis. Accordingly, passivity of the ER pathway and activity of the TGF-β pathway and the PI3K pathway were found by the inventors to be correlated with a poor outcome in breast cancer patients.

These inventors' observations from biology research and the clinical correlations that the activities of the TGF-β pathway, the PI3K pathway, the Wnt pathway, and the pathway may play a role in cancer recurrence and overall survival and that activity of the ER pathway seems to be linked to a good clinical outcome are combined herein in the following exemplary formula, which is a special case of Eq. (4):

$$MPS = w_t \cdot P_t + w_p \cdot P_p + w_w \cdot P_W + w_e \cdot P_e + w_h \cdot P_h + X, \quad (5)$$

wherein $P_t$, $P_p$, $P_w$, $P_e$, and $P_h$ denote the inferred activity of the TGF-β pathway, the PI3K pathway, the Wnt pathway, the ER pathway, and the HH pathway, respectively (e.g., in the range between 0 and 1), $w_t$ is a positive constant weighting coefficient, $w_p$, $w_w$ and $w_h$ are non-negative constant weighting coefficients, and $w_e$ is a non-positive constant weighting coefficient. With this formula, the indicated risk that the subject will experience the clinical event within the certain period of time monotonically increases with an increasing value of the sum.

In the following examples, the inventors have exemplarily used the inferred activities from the Bayesian networks of the TGF-β pathway using the evidence curated list of target genes shown in Table 1 and the training as discussed herein, the PI3K pathway using the shortlist of target genes shown in Table 11 and the training as discussed herein, the Wnt pathway using the evidence curated list of target genes shown in Table 1 of WO 2013/011479 A2 and the training as discussed therein, the ER pathway using the evidence curated list of target genes shown in Table 2 of WO 2013/011479 A2 and the training discussed therein, and the HH pathway using the evidence curated list of target genes shown in Table 3 of WO 2013/011479 A2 and the training discussed therein. Alternatively, the pathway activities can be inferred by means of alternative methods such as using (pseudo-) linear models as discussed herein and in more detail in WO 2014/102668 A2 or alternatively the herein exemplarily used lists of target genes can be replaced by a further selection of the target genes from the evidence curated lists based on their probative nature that were proven to obtain comparable results with respect to the inferred pathway activities. The alternative lists are discussed herein for the TGF-β pathway (see Tables 2 to 4) and the PI3K pathway (see Tables 5 and 6) and discussed in WO 2013/011479 A2 for the Wnt pathway (see Table 6 of WO 2013/011479 A2), the ER pathway (see Table 7 of WO 2013/011479 A2), and the HH pathway (see Table 8 of WO 2013/011479 A2).

Herein, we describe an exemplary method to infer appropriate values for the weighting coefficients $w_t$, $w_p$, $w_w$, $w_e$, and $w_h$ using Cox's proportional hazards models, A Cox's proportional hazard model is fitted to a training set consisting of a suitable number (for example>100, representing the diverse subsets of cancer types) of samples with inferred activities $P_t$, $P_p$, $P_w$, $P_e$, and $P_h$ and survival data, i.e., the survival time and censoring information using, for example MATLAB, (MATLAB R2014a, The MathWorks Inc., Natick, Mass.) or R (v3.0.3, R Core Team (2014). R: A language and environment for statistical computing. R Foundation for Statistical Computing, Vienna, Austria). Exemplarily, the publically available breast cancer samples from GSE6532 originating from the Guy's hospital (n=87) and the samples from GSE9195 (n=77), accessible at ncbi.nlm.nih.gov/geo/, last accessed Jul. 20, 2014, were used as training dataset. A Cox's proportional hazards regression model is fitted for the activity of every pathway, resulting in a Cox's coefficient per pathway activity, its associated standard error (SE) of the coefficient estimate, a hazard ratio (HR), which is the exponent of the Cox's coefficient, a 95% confidence interval of the hazard ratio and a p-value derived from the Cox's coefficient and the standard error as can be seen in Table 22. The sign of the coefficient estimate indicates whether the pathway activity is either protective for the clinical event in case of a negative coefficient or predict worse prognosis in case of a positive coefficient. The modulus of the coefficient indicates the strength of the risk score with respect to prognosis.

TABLE 22

Results of Cox's proportional hazard regression on the combined training sets GSE6532 and GSE9195.

| Risk score | Cox's coefficient | SE | HR | HR 95% CI | | p-value |
|---|---|---|---|---|---|---|
| $P_t$ | 0.98 | .93 | .66 | .43 | 6.46 | 1.47e−01 |
| $P_p$ | 0.80 | .41 | .24 | .00 | .01 | 2.53e−02 |
| $P_w$ | 1.30 | .85 | .67 | .69 | 9.38 | 6.30e−02 |
| $P_e$ | −1.02 | .52 | .36 | .13 | .99 | 2.39e−02 |
| $P_h$ | 0.83 | .54 | .29 | .79 | .61 | 6.37e−02 |

It has been found by the inventors that the Cox's coefficients fitted for the activities of the respective cellular signaling pathways on a training data set, as shown, for example, in Table 22, are good values to use as linear weighting coefficients for the risk scores. Therefore these Cox's coefficients are, in one embodiment, used as the weighting coefficients in Eq. (5). Their suitability for use in determining a risk score has been evaluated in great detail, as described in the following:

First the activity of the TGF-β pathway was combined with the activity of the PI3K pathway, the Wnt pathway, the ER pathway, and the HH pathway, respectively, resulting in the following equations:

$$MPS_{tp}=0.98(\pm0.93)\cdot P_t+0.80(\pm0.41)\cdot P_p \quad (6)$$

$$MPS_{tw}=0.98(\pm0.93)\cdot P_t+1.30(\pm0.85)\cdot P_w \quad (7)$$

$$MPS_{te}=0.98(\pm0.93)\cdot P_t+(-1.02(\pm0.52))\cdot P_e \quad (8)$$

$$MPS_{th}=0.98(\pm0.93)\cdot P_t+0.83(\pm0.54)\cdot P_h \quad (9)$$

Next the activity of the TGF-β pathway was combined with the activities of two other pathways from the group consisting of the PI3K pathway, the Wnt pathway, the ER pathway, and the HH pathway, resulting in the following equations:

$$MPS_{tpw}=0.98(\pm0.93)\cdot P_t+0.80(\pm0.41)\cdot P_p+1.30(\pm0.85)\cdot P_w \quad (10)$$

$$MPS_{tpe}=0.98(\pm0.93)\cdot P_t+0.80(\pm0.41)\cdot P_p+(-1.02(\pm0.52))\cdot P_e \quad (11)$$

$$MPS_{tph}=0.98(\pm0.93)\cdot P_t+0.80(\pm0.41)\cdot P_p+0.83(\pm0.54)\cdot P_h \quad (12)$$

$$MPS_{twe}=0.98(\pm0.93)\cdot P_t+1.30(\pm0.85)\cdot P_w+(-1.02(\pm0.52))\cdot P_e \quad (13)$$

$$MPS_{twh}=0.98(\pm0.93)\cdot P_t+1.30(\pm0.85)\cdot P_w+0.83(\pm0.54)+P_h \quad (14)$$

$$MPS_{teh}=0.98(\pm0.93)\cdot P_t+(-1.02(\pm0.52))\cdot P_e+0.83(\pm0.54)\cdot P_h \quad (15)$$

Next the activity of the TGF-β pathway was combined with the activities of three other pathways from the group consisting of the PI3K pathway, the Wnt pathway, the ER pathway, and the HH pathway, resulting in the following equations:

$$MPS_{tpwe} = 0.98(\pm0.93)\cdot P_t + 0.80(\pm0.41)\cdot P_p + 1.30(\pm0.85)\cdot P_w + (-1.02(\pm0.52))\cdot P_e \quad (16)$$

$$MPS_{tpwh} = 0.98(\pm0.93)\cdot P_t + 0.80(\pm0.41)\cdot P_p + 1.30(\pm0.85)\cdot P_w + 0.83(\pm0.54)\cdot P_h \quad (17)$$

$$MPS_{tpeh} = 0.98(\pm0.93)\cdot P_t + 0.80(\pm0.41)\cdot P_p + (-1.02(\pm0.52))\cdot P_e + 0.83(\pm0.54)\cdot P_h \quad (18)$$

$$MPS_{tweh} = 0.98(\pm0.93)\cdot P_t + 1.30(\pm0.85)\cdot P_w + (-1.02(\pm0.52))\cdot P_e + 0.83(\pm0.54)\cdot P_h \quad (19)$$

In one embodiment, the Cox's coefficients are used to parameterize the linear combination of the activities of the TGF-β pathway, the PI3K pathway, the Wnt pathway, the ER pathway, and the HH pathway listed in Eq. (5), which resulted in the following equation:

$$MPS_{tpweh} = 0.98(\pm0.93)\cdot P_t + 0.80(\pm0.41)\cdot P_p ++1.30(\pm0.85)\cdot P_w + (-1.02(\pm0.52))\cdot P_e + 0.83(\pm0.54)\cdot P_h \quad (20)$$

wherein the standard errors of the coefficients are listed between the parentheses.

Alternatively, one can use (pseudo-)linear models to infer the pathway activity as described herein and in more detail in WO 2014/102668 A2 ("Assessment of cellular signaling pathway activity using linear combination(s) of target gene expressions") and use these inferred activities in a similar fashion as discussed above with pathway activities inferred with a probabilistic model. Inserting these linear models for pathway activity into Eqs. (6) to (20) eventually culminates, after expansion of the summations, into a linear combination that can be generalized into an equation with a single summation:

$$MPS_{probesets}=\Sigma w_{ij}\cdot E_{ij} \quad (21)$$

wherein Σ is the sum of all i probesets of all j pathways, here the TGF-β pathway, the PI3K pathway, the Wnt pathway, the ER pathway, and the HH pathway, $w_{ij}$ is the weight associated with the probeset, which equals the product of the weight associated with the pathway and the probeset or pathway, target gene and probeset, for the "single-layer" and "two-layer" linear models, respectively. Herein, the weight is exemplarily chosen equal to the Cox's coefficient estimated from the training data set, of the i-th probeset of the j-th pathway, and $E_{ij}$ is the i-th probeset of the j-th pathway. A person skilled in the art will be able to adapt this equation to other measuring platforms such as (RT-q)PCR, sequencing, mRNA fish, and other suitable methods to detect expression levels of the target genes instead of the probesets originating from the Affymetrix HG-U133Plus2.0 exemplarily used herein.

Next the risk scores as described herein were tested on a combination of three other datasets: GSE20685 and GSE21653 are available at the gene expression omnibus, accessible at ncbi.nlm.nih.gov/geo/, last accessed Jul. 20, 2014, whereas E-MTAB-365 is available at ArrayExpress, accessible at ebi.ac.uk/arrayexpress/experiments/, last accessed Jul. 20, 2014. The three datasets combine a diverse set of in total 1005 breast cancer patients with complete survival time and censoring data. The risk scores for these patients were calculated according to Eqs. (6) to (21) and then the prognostic value of the risk scores was investigated using two methods that quantize such a prognostic value. These are Cox's proportional hazard regression models and Kaplan-Meier plots in conjunction with the log-rank statistical test:

The first method fits a Cox's proportional hazard model to the survival data with one or more covariates. In short, such a hazard model explains the variation in survival (clinical event) within the population based on the (numerical) value of the covariates. As a result of the fit, each included covariate will be assigned a hazard ratio (HR), which is the exponent of the Cox's coefficient, which quantifies the associated risk of the clinical event based on the covariate's value, e.g., a HR of two corresponds with a two times higher risk of the clinical event of interest for patients with an increase of one in the covariate's value. In detail, a value of HR=1 means that this covariate has no impact on survival, whereas for HR<1, an increase in the covariate number signifies a lower risk and a decrease in the covariate number signifies a higher risk, and for HR>1, an increase in the covariate number signifies a higher risk and a decrease in the covariate number signifies a lower risk. Along with the hazard ratios, the 95% confidence interval and p-values are reported (i.e., the one-sided probability, that the hazard ratio is significantly less or greater than one). All risk scores are scaled such that the scale (minimum to maximum value) of the risk score is one in order to make a direct comparison of hazard ratios straightforward.

The latter method involves plotting a Kaplan-Meier curve that represents the probability of surviving the clinical event as a function of time. For example, by plotting the Kaplan-Meier curves for different risk groups in the population based on an exemplary prognostic test, one can visualize the quality of the separation of risk of the exemplary clinical event. That is, more diverging risk groups indicate that a risk score is better at stratifying risky patients. This quality can be further quantized by means of a log-rank test, which calculates the probability (p-value) that two survival curves are equal taking into account the complete follow-up period.

The results of the risk scores using at least the inferred activity of the TGF-β pathway and one or more of the Wnt pathway, the ER pathway, and the HH pathway, as presented herein, were benchmarked compared to the individual inferred activities $P_t$, $P_p$, $P_w$, $P_e$, and $P_h$, i.e., the inferred activities of the TGF-β pathway, the PI3K pathway, the Wnt pathway, the ER pathway, and the HH pathway, respectively, and as described herein, a non-linear combination of $P_e$, $P_w$, $P_h$, and the breast cancer Oncotype DX® test from Genomic Health. The non-linear combination of $P_e$, $P_w$, and $P_h$ is calculated as follows:

$$MPS_{ewh} = -P_e + \max(P_w, P_h) \quad (22)$$

The $MPS_{ewh}$ was shown to be a good predictor for recurrence in breast cancer patients. It was calculated using Eq. (22) and patients were stratified into low risk, intermediate risk and high risk patients using thresholds for the $MPS_{ewh}$ as described therein, i.e., at −0.1 and 0.1, respectively. The Oncotype DX® test was shown to be a good predictor for recurrence in ER positive breast cancer patients. The Oncotype DX® test returns a risk or recurrence score (RS) between 0 and 100, which is scaled here between 0 and 1 for direct comparison of the hazard ratios, that is calculated based on a combination of expression levels measured for a panel of genes (see S. Paik et al.: "A multi-gene assay to predict recurrence of Tamoxifen-treated, node-negative breast cancer", The New England Journal of Medicine, Vol, 351. No. 27, (2004), pages 2817 to 2826; C. Fan et al.: "Concordance among gene-expression-based predictors for breast cancer", The New England Journal of Medicine, Vol. 355, No. 6, (2006), pages 560 to 569). The RS is optimized with respect to 10-year survival in ER positive. HER2 negative (protein staining or FISH), node negative breast cancer patients. The RS was calculated using the microarray expression data reported in the mentioned datasets following the procedure reported by Fan et al. (see C. Fan et al. (2006)) and patients were subsequently divided into low risk, intermediate risk, and high risk patients according to the Oncotype DX® risk stratification algorithm (see S. Paik et al. (2004)).

At first Cox's proportional hazards regression was performed on the scaled risk scores using the breast cancer patients from E-MTAB365, GSE20685 and GSE21653. The calculated univariate Cox's coefficient, its standard error, hazard ratios, associated 95% confidence interval and p-value are shown in Table 23. Strikingly, all risk scores combining the activity of the TGF-β pathway with the activity of one of the other cellular signaling pathways perform better than the individual pathway activities, as depicted by a higher modulus of the Cox's coefficients, which indicate that a combination of the activity of the TGF-β pathway together with the activity of (an)other cellular signaling pathway(s) performed better than the individual pathway activities with respect to prognosis of a clinical event, in this case, disease free survival. In addition, the p-values of the combinations activities of two cellular signaling pathways also demonstrate this superiority as they are typically smaller for the combinations of the activity of the TGF-β pathway with the activity of another cellular signaling pathway than those of the individual pathway activities. Combining the activity of the TGF-β pathway with the activities of two other cellular signaling pathways also improved the Cox's coefficients (and p-values) compared to the risk scores based on two pathway activities. The $MPS_{tpe}$ and the $MPMS_{tpweh}$ risk scores combining the activities of the TGF-β pathway, the PI3K pathway, the ER pathway, as described in Eq. (11), and the activities of the TGF-β pathway, the PI3k pathway, the Wnt pathway, the ER pathway, and the HH pathway, as described in Eq. (20), respectively, perform similar and outperform the other combinations, i.e., they perform better than the individual pathway activities as well as the other combinations of the activity of the TGF-β pathway with the activities of one, two or three other cellular signaling pathways, as is visible in the coefficient, standard error, HR and p-value. In addition, the $MPS_{probesets}$ risk score including the same probesets as used in the $MPS_{tpweh}$ score outperforms the risk scores including the activity of the TGF-β pathway and the activity of one or two other cellular signaling pathways, as is evident from the Cox's regression results. Nevertheless, the performance of the $MPS_{probesets}$ is marginally worse than the $MPS_{tpweh}$ which is likely the result of 'overrating' the risk score on the training data due to high amount of fitted coefficients (339 coefficients in $MPS_{probesets}$ vs. five coefficients in $MPS_{tpweh}$). All risk scores that combine the activity of the TGF-β pathway and the activities of one or more other pathways performed better than the $MPS_{ewh}$ and RS risk scores, as is evident from the respective Cox's coefficient.

TABLE 23

Results of Cox's proportional hazard regression on the combined test sets E-MTAB-365, GSE20685 and GSE21653. All risk scores are normalized for a direct comparison of the regression results. The Cox's coefficient calculated on the test set gives the "strength" (and direction) of the risk score with respect to survival. A high (absolute) value corresponds to a strong predictor. Hence, the "strength" is a quantification of the prognostic power of the risk score.

| Risk score | Cox's Coefficient | SE | HR | HR 95% CI | | p-value (Cox's regression) | p-value (log-rank) |
|---|---|---|---|---|---|---|---|
| $MPS_{tp}$ | 2.12 | .29 | .31 | .72 | 4.64 | 1.16e-13 | 1.7e-09 |
| $MPS_{tw}$ | 1.27 | .30 | .56 | .96 | .44 | 1.41e-05 | 2.9e-03 |
| $MPS_{te}$ | 1.92 | .29 | .85 | .85 | 2.19 | 3.07e-11 | 8.7e-09 |
| $MPS_{th}$ | 1.86 | .27 | .40 | .75 | 0.95 | 5.71e-12 | 5.8e-09 |
| $MPS_{tpw}$ | 1.70 | .28 | .47 | .17 | .43 | 4.88e-10 | 1.4e-08 |
| $MPS_{tpe}$ | 2.55 | .32 | 2.75 | .74 | 4.10 | 2.33e-15 | 7.1e-13 |
| $MPS_{tph}$ | 1.95 | .24 | .06 | .43 | 1.26 | 1.11e-16 | 1.5e-10 |
| $MPS_{twe}$ | 1.88 | .33 | .53 | .46 | 2.36 | 3.84e-09 | 4.1e-07 |
| $MPS_{twh}$ | 1.73 | .32 | .67 | .04 | 0.57 | 2.54e-08 | 4.2e-04 |
| $MPS_{teh}$ | 2.31 | .32 | 0.09 | .40 | 8.86 | 2.22e-13 | 1.3e-10 |
| $MPS_{tpwe}$ | 2.23 | .31 | .26 | .01 | 7.11 | 5.91e-13 | 6.8e-12 |
| $MPS_{tpwh}$ | 2.06 | .29 | .83 | .42 | 3.87 | 8.27e-13 | 4.5e-09 |
| $MPS_{tpeh}$ | 2.46 | .29 | 1.66 | .57 | 0.70 | 2.51e-17 | 2.9e-12 |
| $MPS_{tweh}$ | 2.19 | .34 | .94 | .62 | 7.92 | 4.0e-11 | 6.6e-09 |
| $MPS_{tpweh}$ | 2.46 | .32 | 1.72 | .26 | 1.95 | 7.29e-15 | 8.6e-12 |
| $MPS_{probesets}$ | 2.42 | .39 | 1.20 | .17 | 4.23 | 4.32e-10 | 1.3e-07 |
| $P_t$ | 1.21 | .21 | .36 | .21 | .11 | 7.09e-09 | 9.3e-07 |
| $P_p$ | 0.82 | .18 | .26 | .58 | .24 | 4.17e-06 | 1.6e-04 |
| $P_w$ | 0.29 | .27 | .34 | .79 | .27 | 0.14 | 0.20 |
| $P_e$ | −0.81 | .19 | .44 | .30 | .65 | 1.48e-05 | 0.001 |
| $P_h$ | 0.92 | .21 | .52 | .66 | .81 | 6.11e-06 | 9.9e-05 |
| $MPS_{ewh}$ | 1.21 | .24 | .37 | .09 | .42 | 3.01e-07 | 3.0e-06 |
| RS | 1.00 | .16 | .71 | .00 | .67 | 7.59e-11 | 8.9e-10 |

Using the alternative lists of target genes of the TGF-β pathway, i.e., the "20 genes shortlist", the "12 genes shortlist", and the "7 genes shortlist" (see Tables 2 to 4), respectively, resulted in comparable results. This can be seen from Table 24 which shows the results for the $MPS_{tpweh}$ using the "20 genes shortlist", the "12 genes shortlist", and the "7 additional genes shortlist". These results indicate that the "strength" of the risk scores become slightly lower in case the shortlists are used. Nevertheless, they perform better than the risk scores without the TGF-β pathway activity.

TABLE 24

Additional results for the "20 genes shortlist", the "12 genes shortlist", and the "7 genes shortlist".

| Risk score | Cox's Coefficient | SE | HR | HR 95% CI | | p-value (Cox's regression) | p-value (log-rank) |
|---|---|---|---|---|---|---|---|
| $MPS_{tpweh}$ (20 genes) | 2.42 | .32 | 1.27 | .04 | 1.04 | 1.36e−14 | 8.43e−12 |
| $MPS_{tpweh}$ (12 genes) | 2.25 | .33 | .50 | .97 | 8.13 | 4.45e−12 | 5.14e−10 |
| $MPS_{tpweh}$ (7 genes) | 2.21 | .35 | .10 | .59 | 8.06 | 1.33e−10 | 9.3e−10 |

Figure 2:
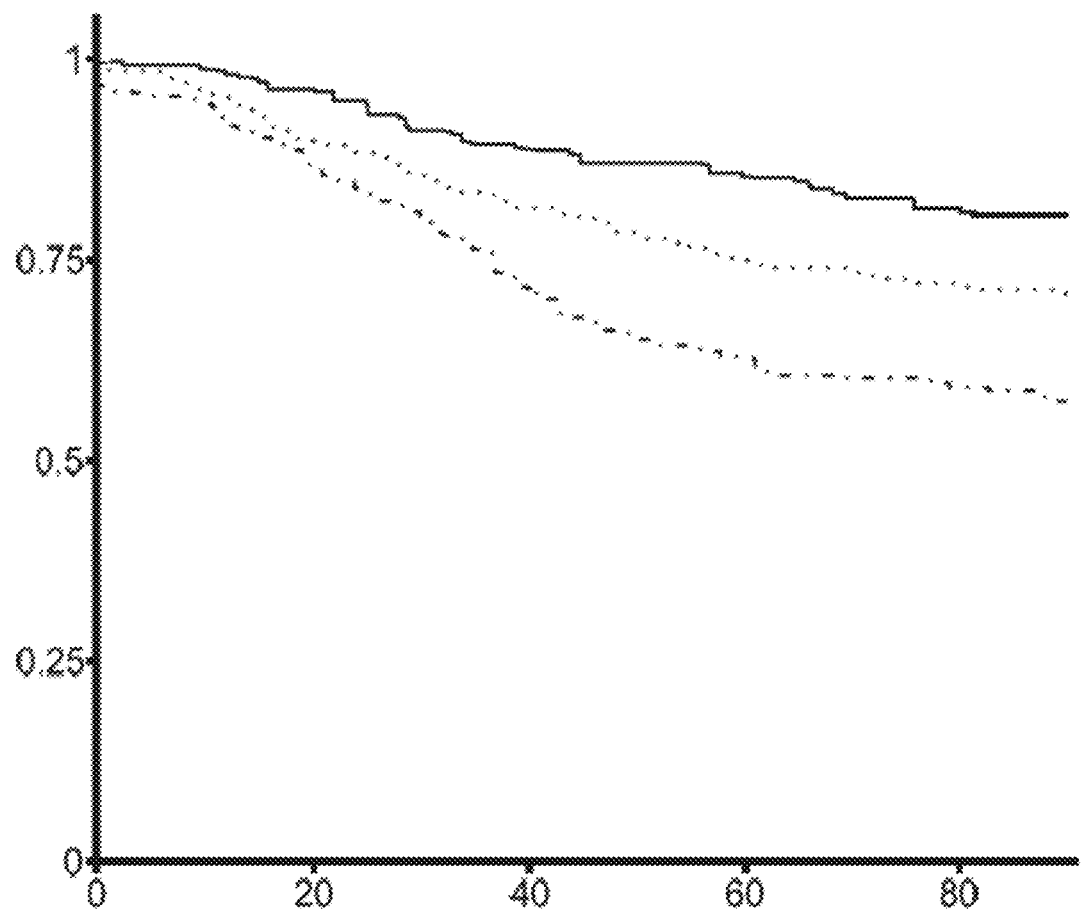
FIG. 2 shows a Kaplan-Meier plot of the disease free survival in breast cancer patients of E-MTAB-365, GSE20685 and GSE21653. The three patient groups are separated based on the tertiles of the $MPS_{tp}$ risk score, which is a combination of the inferred activities of the TGF-β pathway and the PI3K pathway. The difference between the survival curves of the high and low risk patients is clearly significant (log-rank test: p=1.7e-9).
Figure 3:
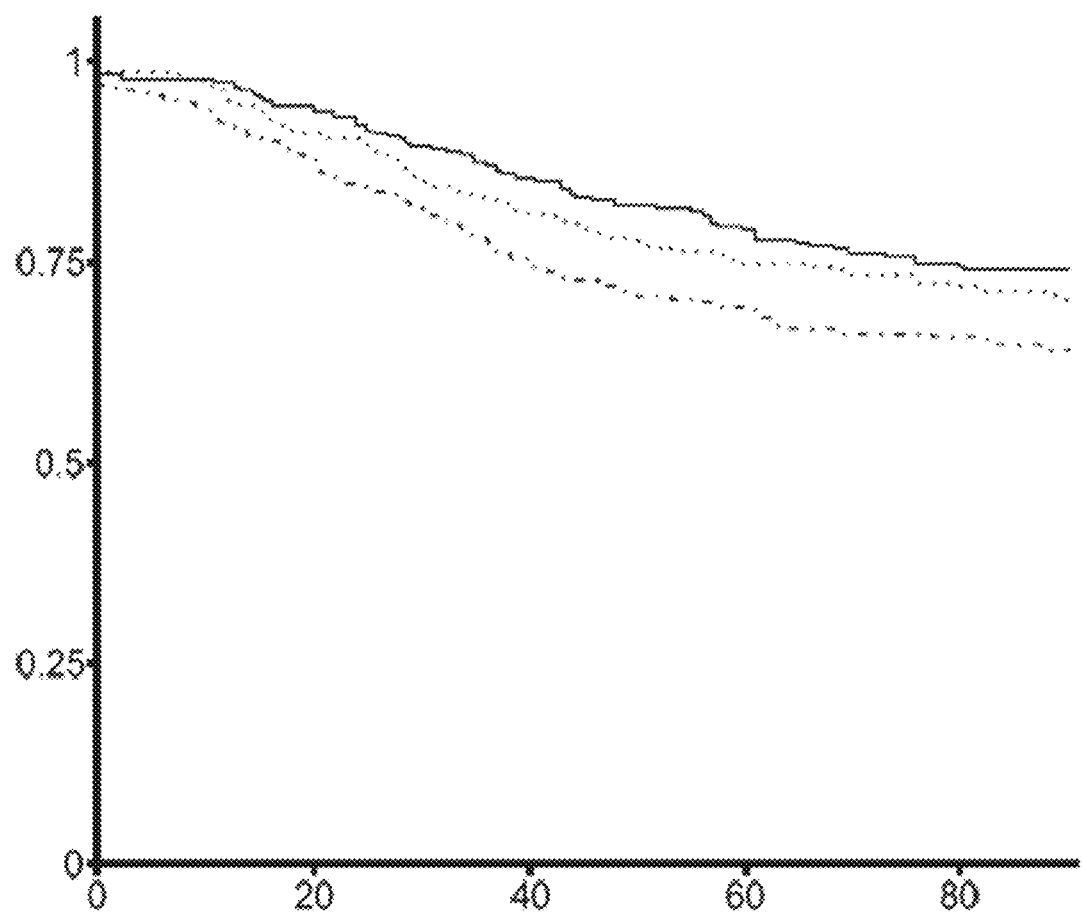
FIG. 3 shows a Kaplan-Meier plot of the disease free survival in breast cancer patients of E-MTAB-365, GSE20685 and GSE21653. The three patient groups are separated based on the tertiles of the $MPS_{tw}$ risk score, which is a combination of the inferred activities of the TGF-β pathway and the Wnt pathway. The difference between the survival curves of the high and low risk patients is clearly significant (log-rank test: p=2,9e-3).
Figure 4:
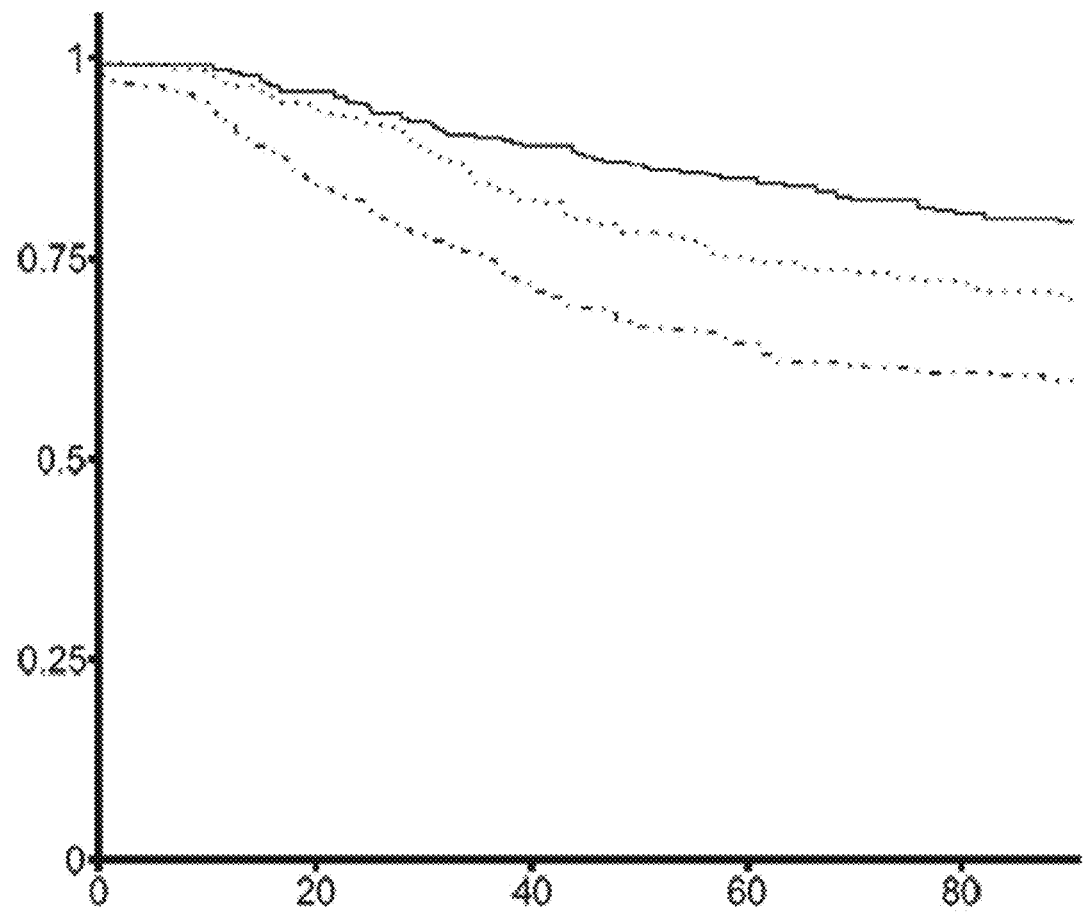
FIG. 4 shows a Kaplan-Meier plot of the disease free survival in breast cancer patients of E-MTAB-365, GSE20685 and GSE21653. The three patients groups are separated based on the tertiles of the $MPS_{tw}$ risk score, which is a combination of the inferred activities of the TGF-β pathway and the Wnt pathway. The difference between the survival curves of the high and low risk patients is clearly significant (log-rank test: p=8.7e-9).
Figure 5:
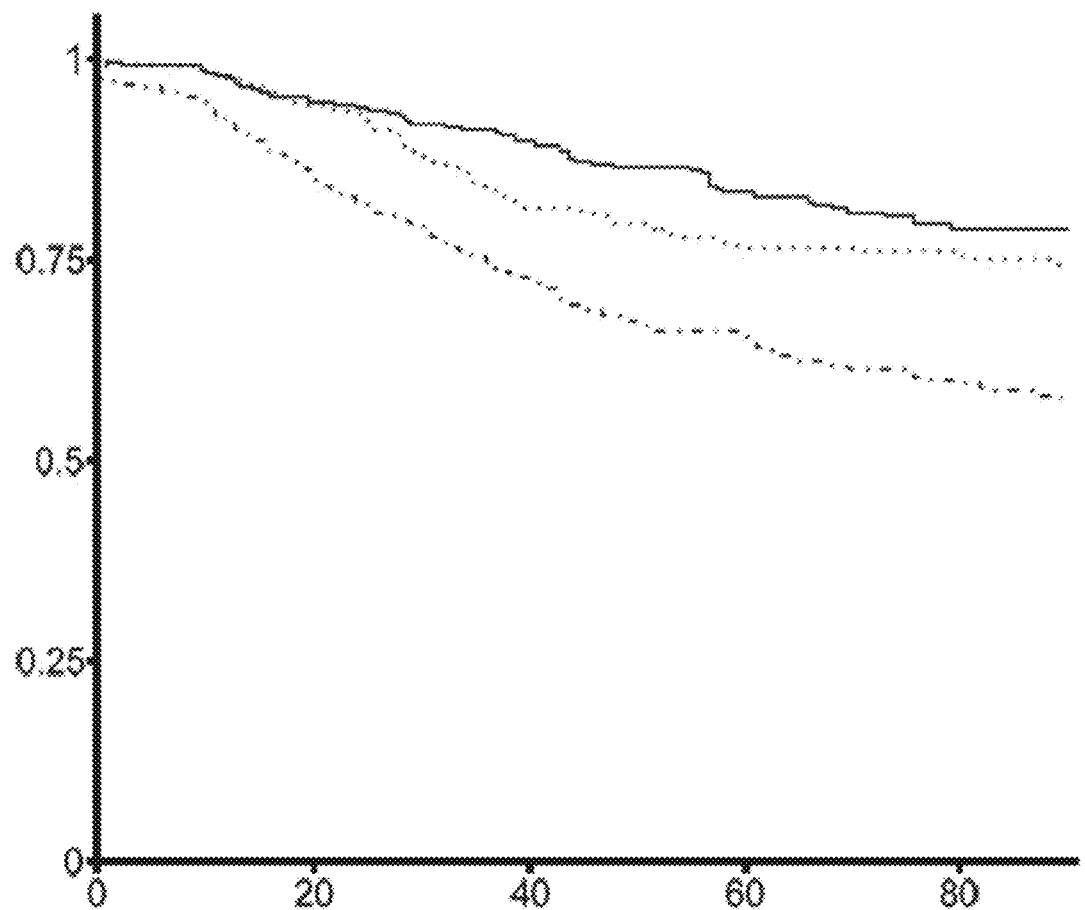
FIG. 5 shows a Kaplan-Meier plot of the disease free survival in breast cancer patients of E-MTAB-365, GSE20685 and GSE21653. The three patient groups are separated based on the tertiles of the $MPS_{th}$ risk score, which is a combination of the inferred activities of the TGF-β pathway and the HH pathway. The difference between the survival curves of the high and low risk patients is clearly significant (log-rank test: p=5.8e-9).
Figure 6:
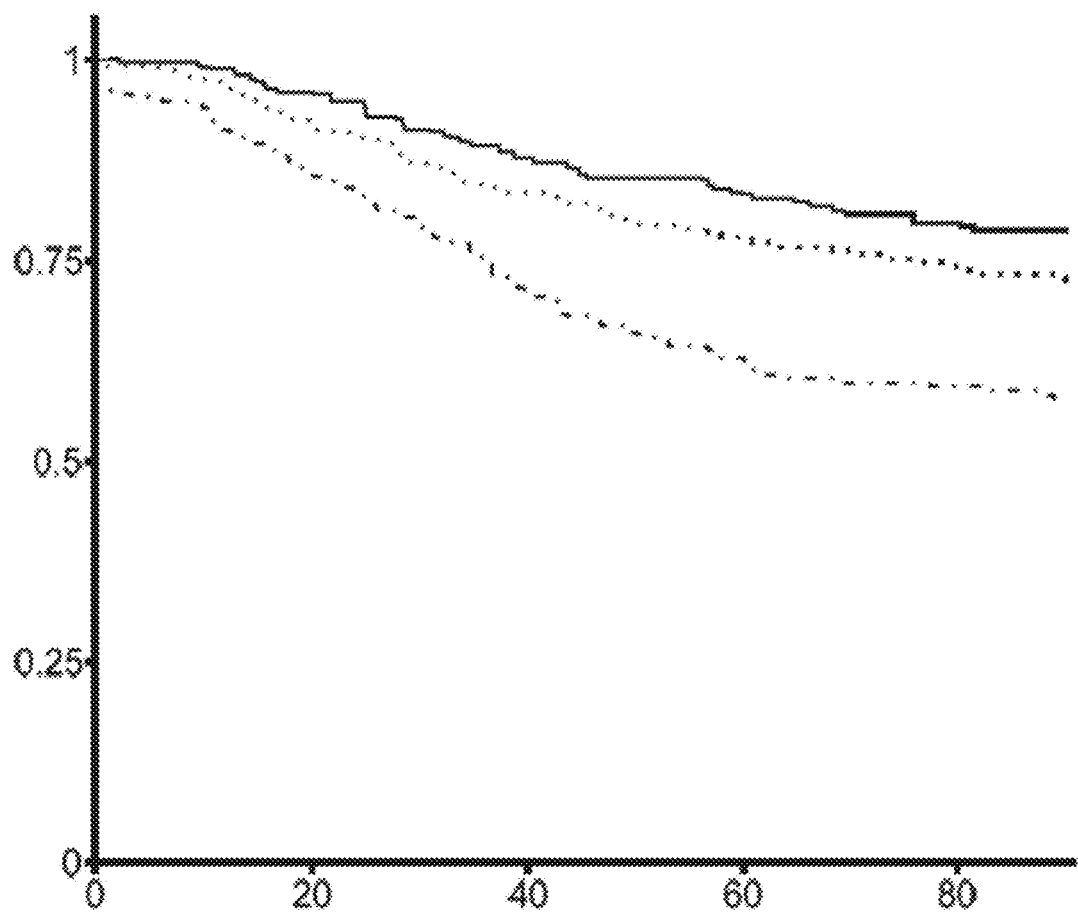
FIG. 6 shows a Kaplan-Meier plot of the disease free survival in breast cancer patients of E-MTAB-365, GSE20685 and GSE21653. The three patient groups are separated based on the tertiles of the $MPS_{tpw}$ risk score, which is a combination of the inferred activities of the TGF-β pathway, the PI3K pathway, and the Wnt pathway. The difference between the survival curves of the high and low risk patients is clearly significant (log-rank test: p=1.4e-8).
Figure 7:
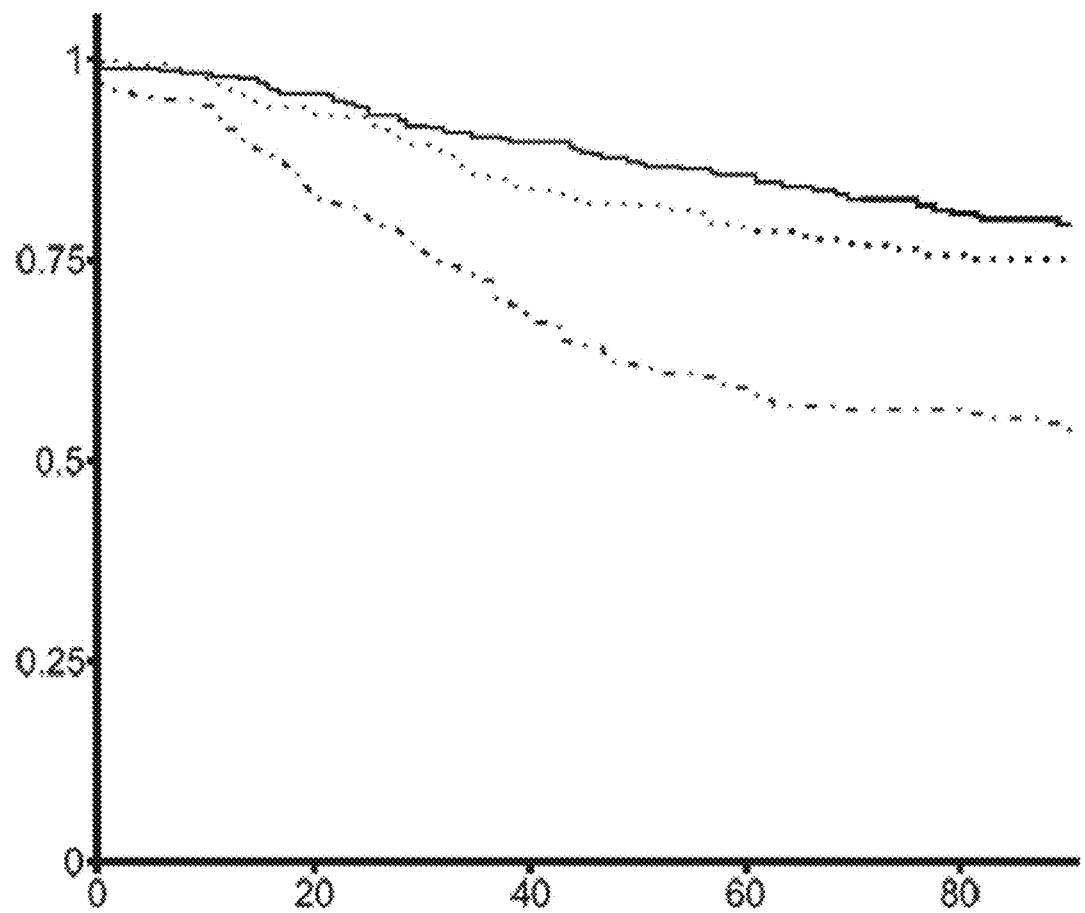
FIG. 7 shows a Kaplan-Meier plot of the disease free survival in breast cancer patients of E-MTAB-365, GSE20685 and GSE21653. The three patient groups are separated based on the tertiles of the $MPS_{tpe}$ risk score, which is a combination of the inferred activities of the TGF-β pathway, the PI3K pathway, and the ER pathway. The difference between the survival curves of the high and low risk patients is clearly significant (log-rank test: p=7.1e-13).
Figure 8:
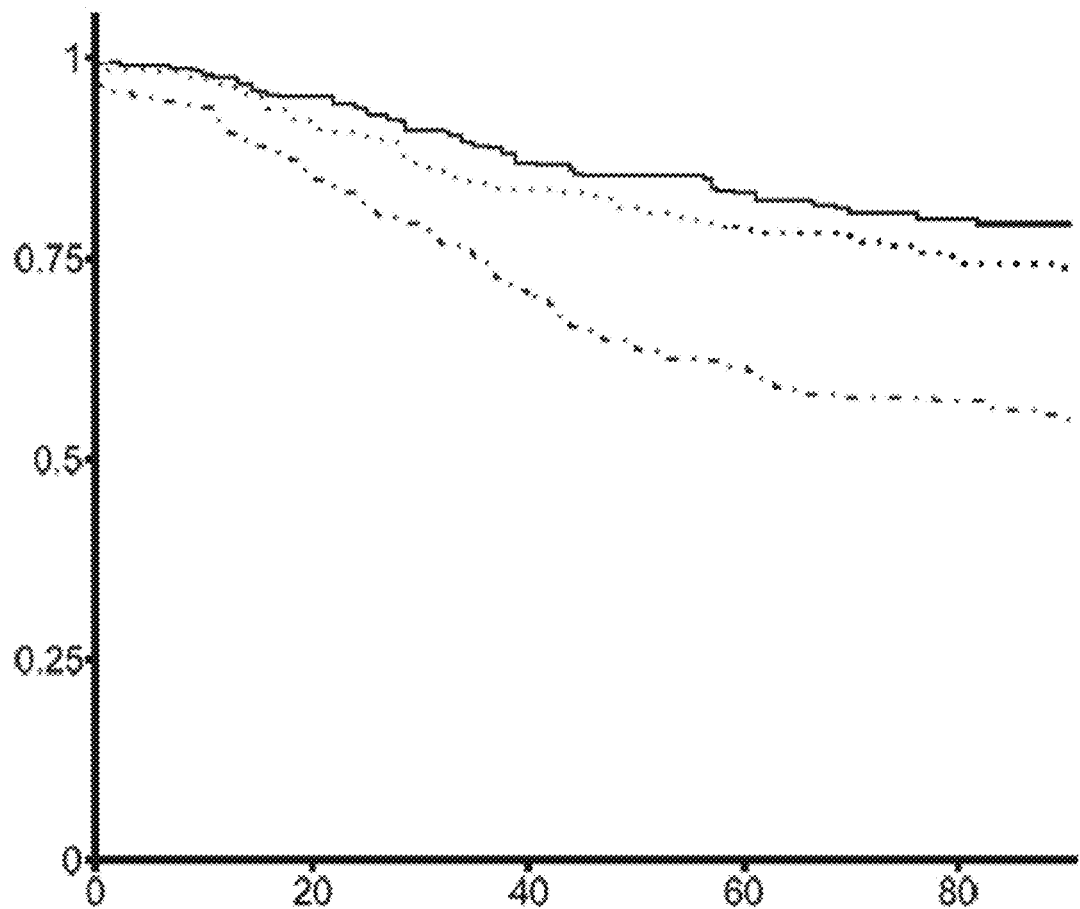
FIG. 8 shows a Kaplan-Meier plot of the disease free survival in breast cancer patients of E-MTAB-365, GSE20685 and GSE21653. The three patient groups are separated based on the tertiles of the $MPS_{tph}$ risk score, which is a combination of the inferred activities of the TGF-β pathway, the PI3K pathway, and the HH pathway. The difference between the survival curves of the high and low risk patients is clearly significant (log-rank test: p=1.5e-10).
Figure 9:
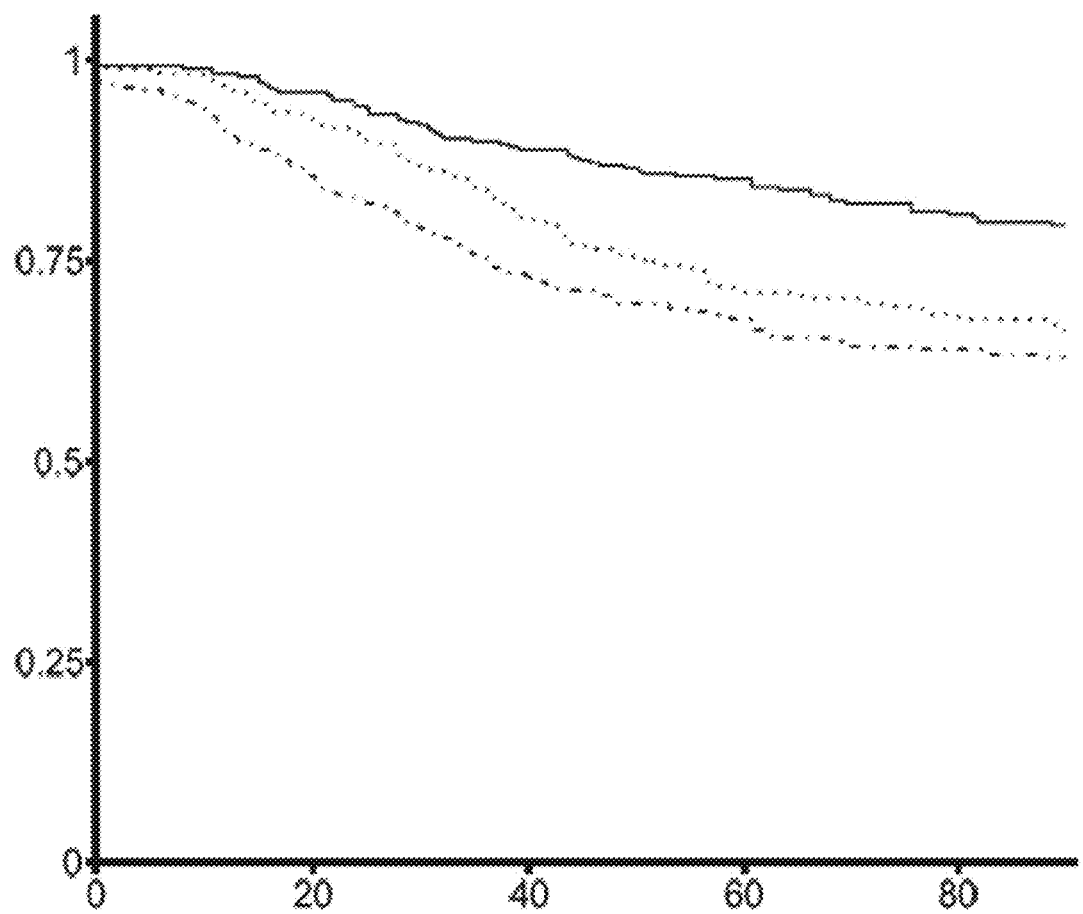
FIG. 9 shows a Kaplan-Meier plot of the disease free survival in breast cancer patients of E-MTAB-365, GSE20685 and GSE21653. The three patient groups are separated based on the tertiles of the $MPS_{twe}$ risk score, which is a combination of the inferred activities of the TGF-β pathway, the Wnt pathway, and the ER pathway. The difference between the survival curves of the high and low risk patients is clearly significant (log-rank test: p=4.1e-7).
Figure 10:
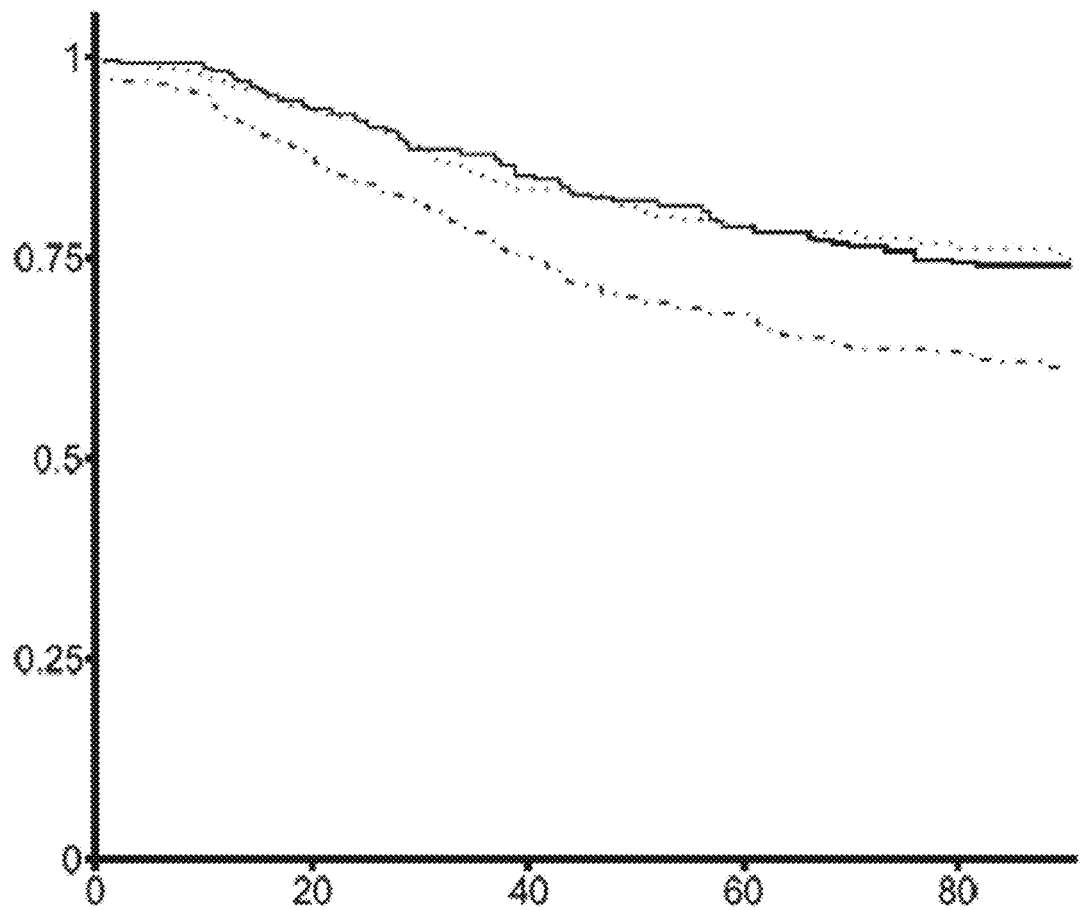
FIG. 10 shows a Kaplan-Meier plot of the disease free survival in breast cancer patients of E-MTAB-365. GSE20685 and GSE21653. The three patient groups are separated based on the tertiles of the $MPS_{twh}$ risk score, which is a combination of the inferred activities of the TGF-β pathway, the Wnt pathway, and the HH pathway. The difference between the survival curves of the high and low risk patients is clearly significant (log-rank test: p=4.2e-4).
Figure 11:
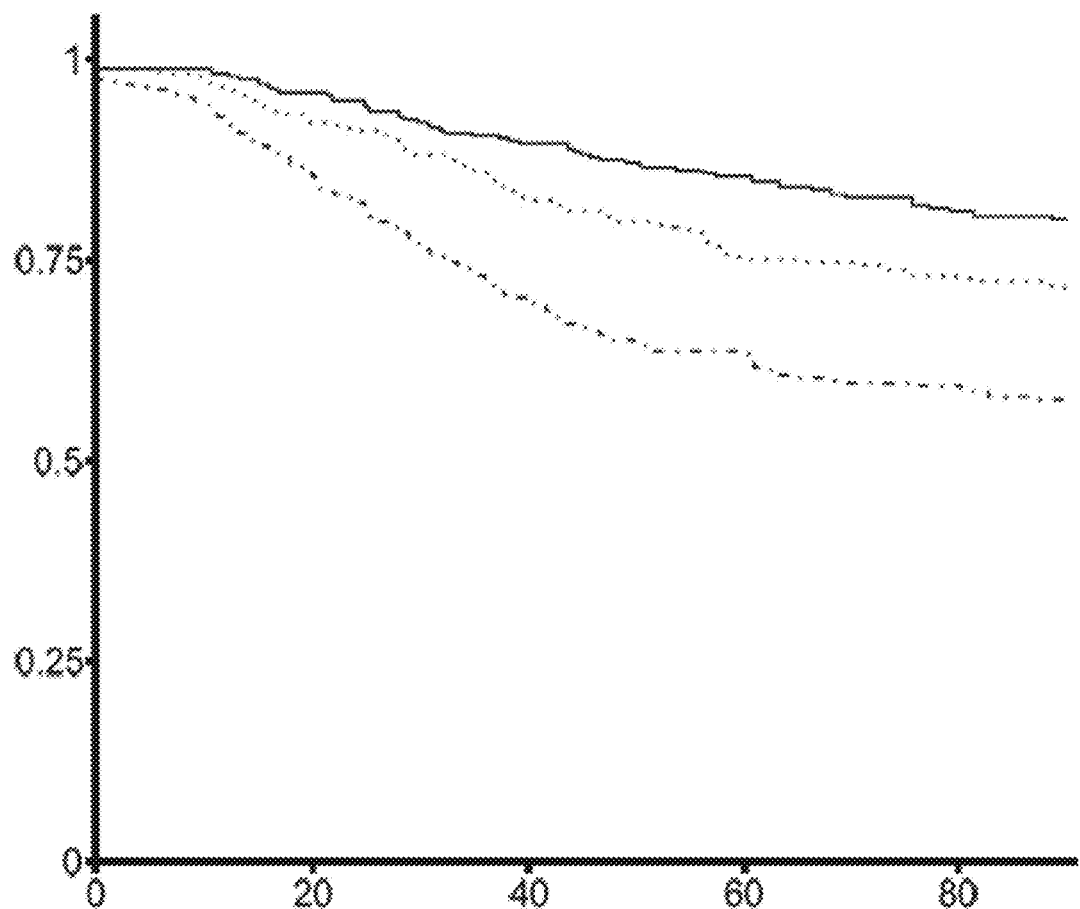
FIG. 11 shows a Kaplan-Meier plot of the disease free survival in breast cancer patients of E-MTAB-365. GSE20685 and GSE21653. The three patient groups are separated based on the tertiles of the $MPS_{teh}$ risk score, which is a combination of the inferred activities of the TGF-β pathway, the ER pathway, and the HH pathway. The difference between the survival curves of the high and low risk patients is clearly significant (log-rank test: p=1.3e-10).
Figure 12:
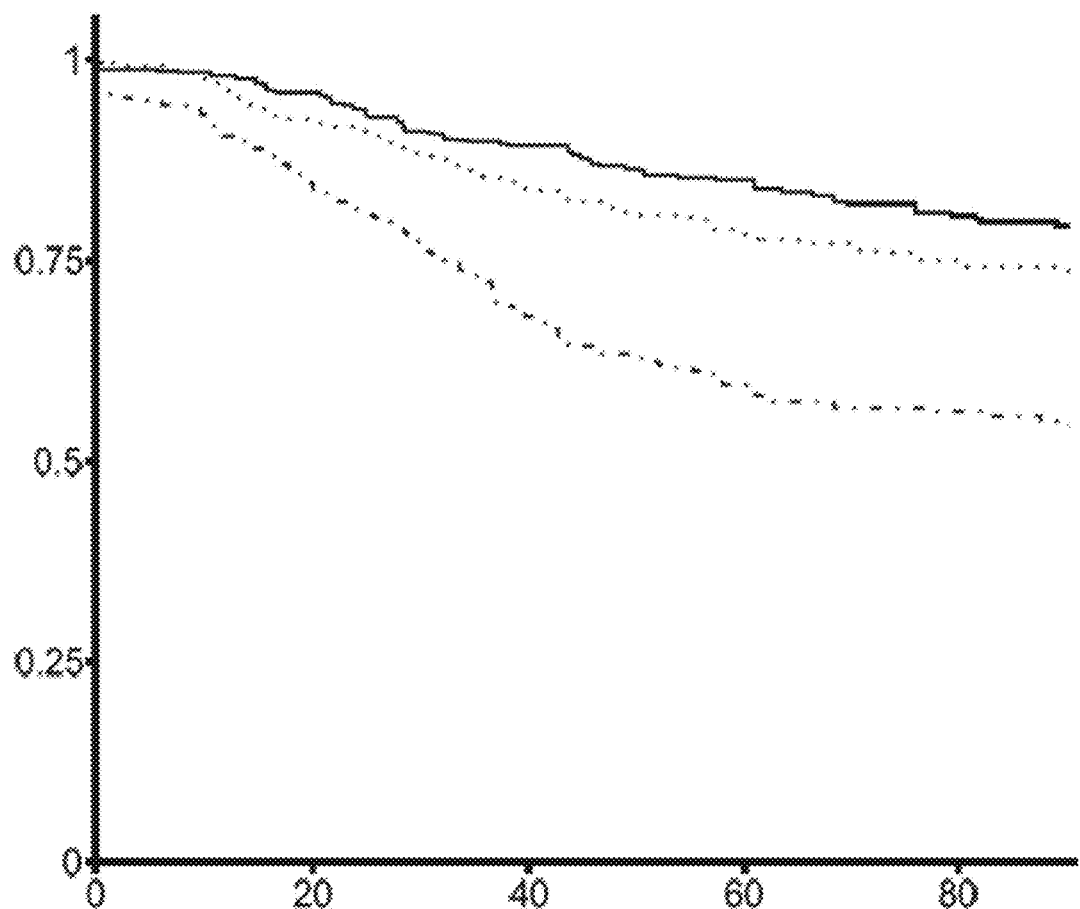
FIG. 12 shows a Kaplan-Meier plot of the disease free survival in breast cancer patients of E-MTAB-365. GSE20685 and GSE21653. The three patient groups are separated based on the tertiles of the $MPS_{tpwe}$ risk score, which is a combination of the inferred activities of the TGF-β pathway, the PI3K pathway, the Wnt pathway, and the ER pathway. The difference between the survival curves of the high and low risk patients is clearly significant (log-rank test: p=6.80-12).
Figure 13:
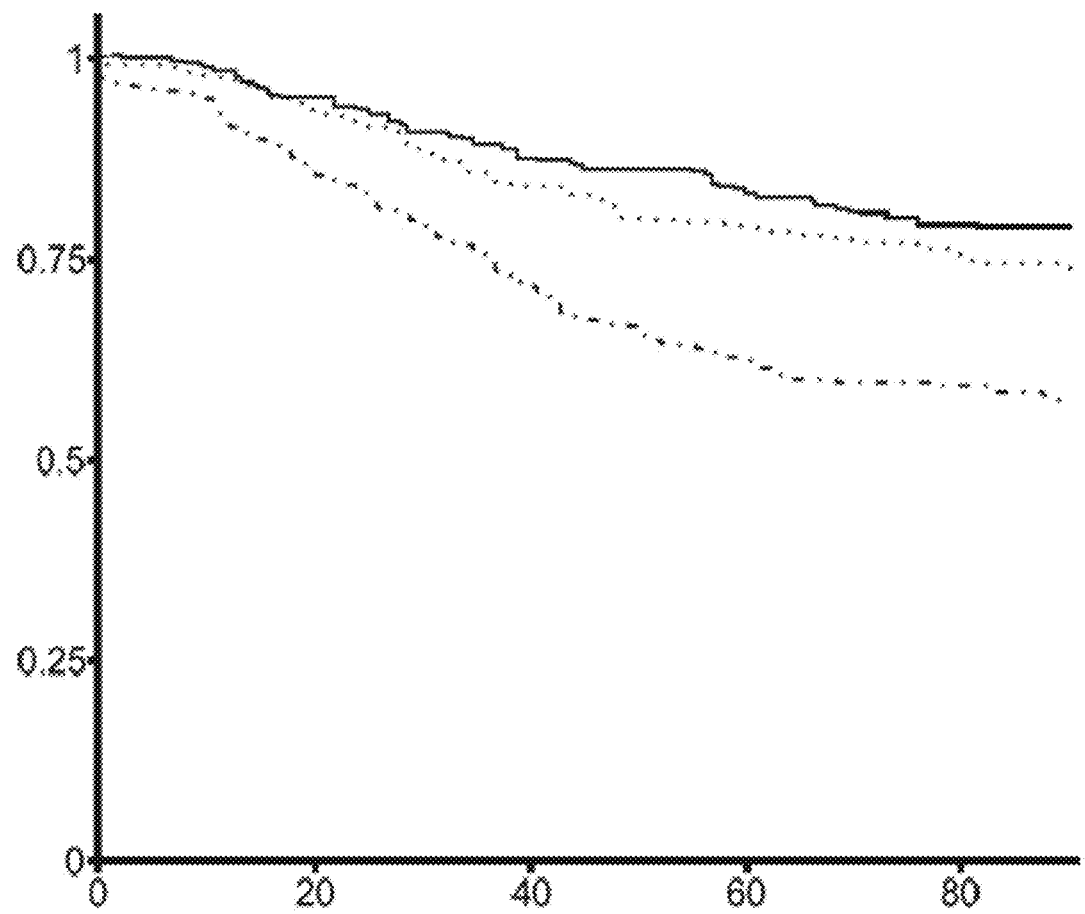
FIG. 13 shows a Kaplan-Meier plot of the disease free survival in breast cancer patients of E-MTAB-365, GSE20685 and GSE21653. The three patient groups are separated based on the tertiles of the $MPS_{tpwh}$ risk score, which is a combination of the interred activities of the TGF-β pathway, the PI3K pathway, the Wnt pathway, and the HH pathway. The difference between the survival curves of the high and low risk patients is clearly significant (log-rank test: p=4.5e-9).
Figure 14:
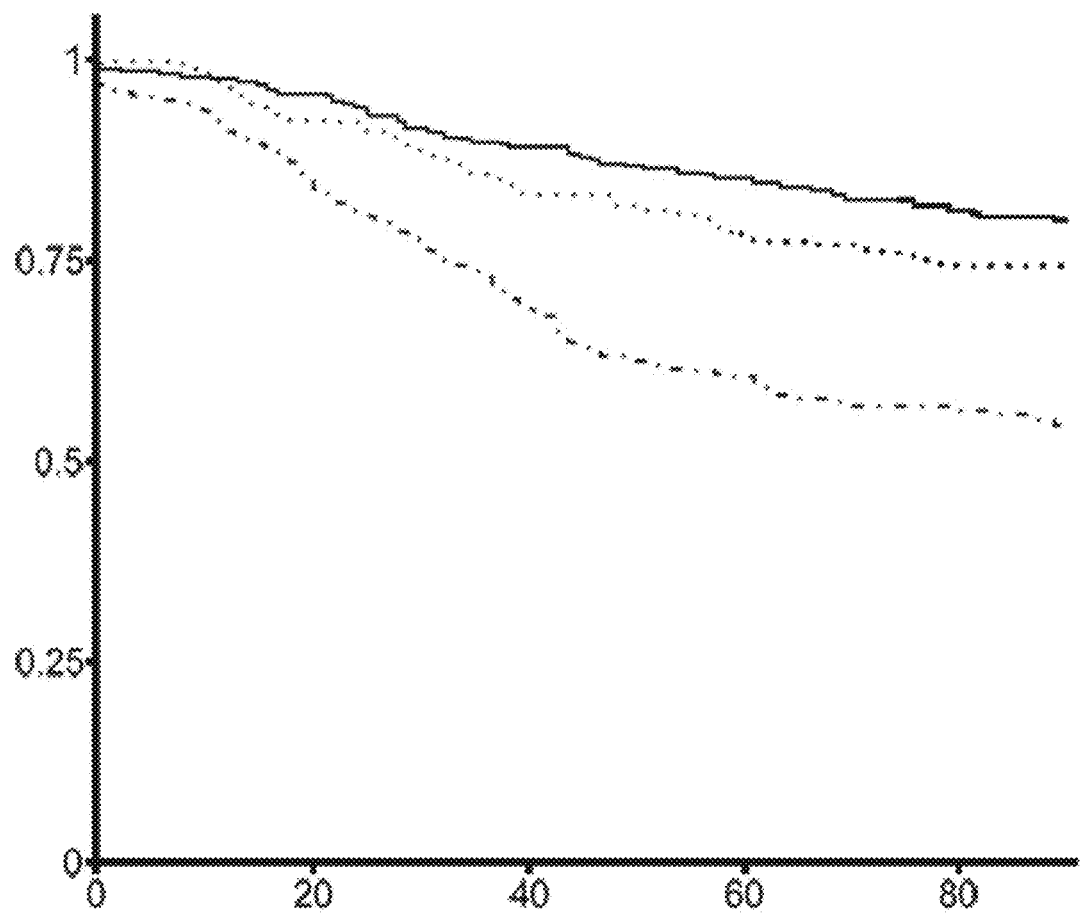
FIG. 14 shows a Kaplan-Meier plot of the disease free survival in breast cancer patients of E-MTAB-365, GSE20685 and GSE21653. The three patient groups are separated based on the tertiles of the $MPS_{tpeh}$ risk score, which is a combination of the inferred activities of the TGF-β pathway, the PI3K pathway, the ER pathway, and the HH pathway. The difference between the survival curves of the high and low risk patients is clearly significant (log-rank test: p=2.9e-12).
Figure 15:
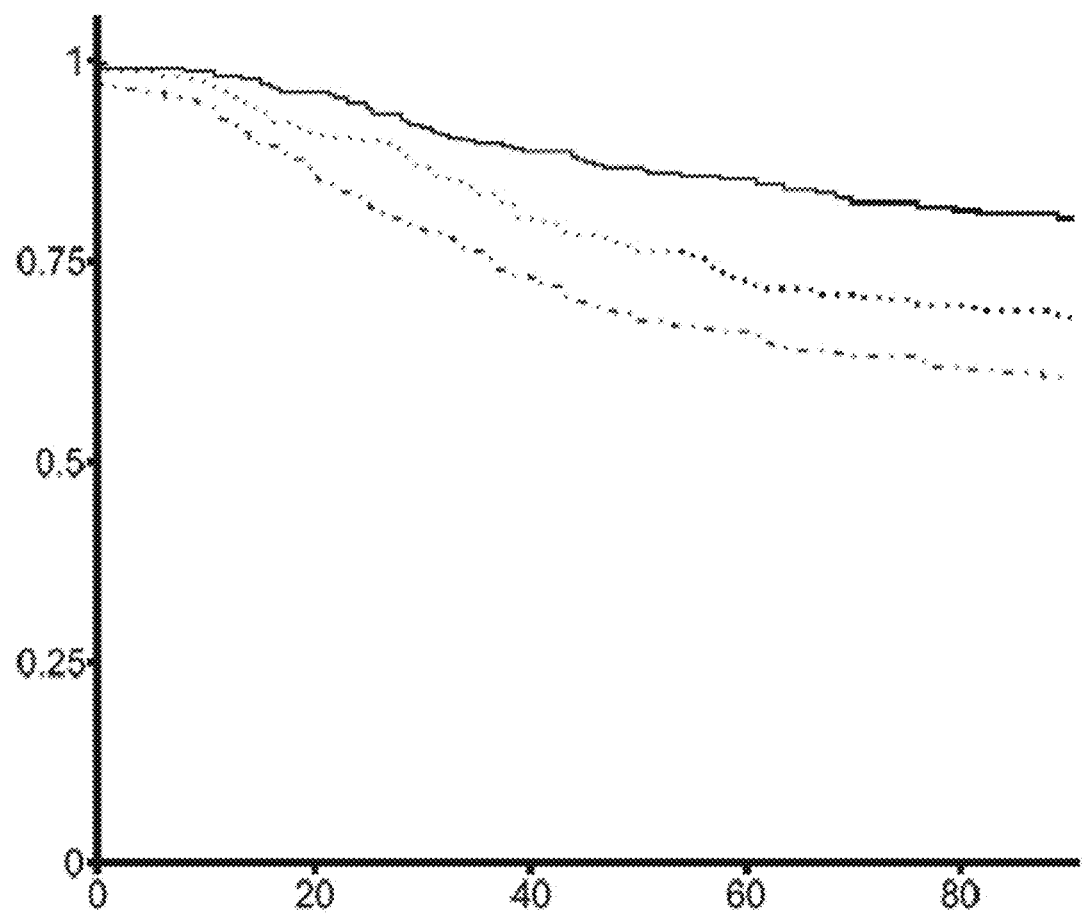
FIG. 15 shows a Kaplan-Meier plot of the disease free survival in breast cancer patients of E-MTAB-365, GSE20685 and GSE21653. The three patient groups are separated based on the tertiles of the $MPS_{tweh}$ risk score, which is a combination of the inferred activities of the TGF-β pathway, the Wnt pathway, the ER pathway, and the HH pathway. The difference between the survival curves of the high and low risk patients is clearly significant (log-rank test: p=6.6e-9).
Figure 16:
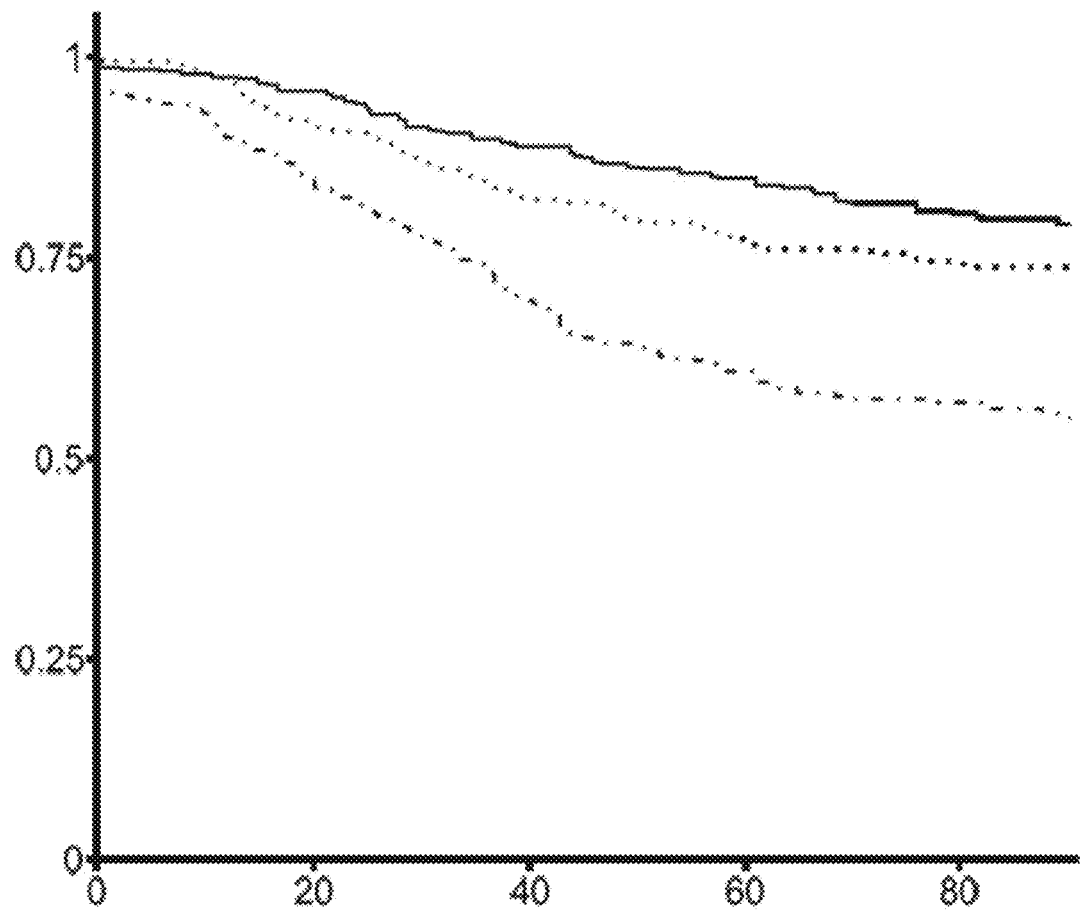
FIG. 16 shows a Kaplan-Meier plot of the disease free survival in breast cancer patients of E-MTAB-365, GSE20685 and GSE21653. The three patient groups are separated based on the tertiles of the $MPS_{tpweh}$ risk score, which is a combination of the inferred activities of the TGF-β pathway, the PI3K pathway, the Wnt pathway, the ER pathway, and the HH pathway. The difference between the survival curves of the high and low risk patients is clearly significant (log-rank test: p==8.6e-12).
Figure 17:
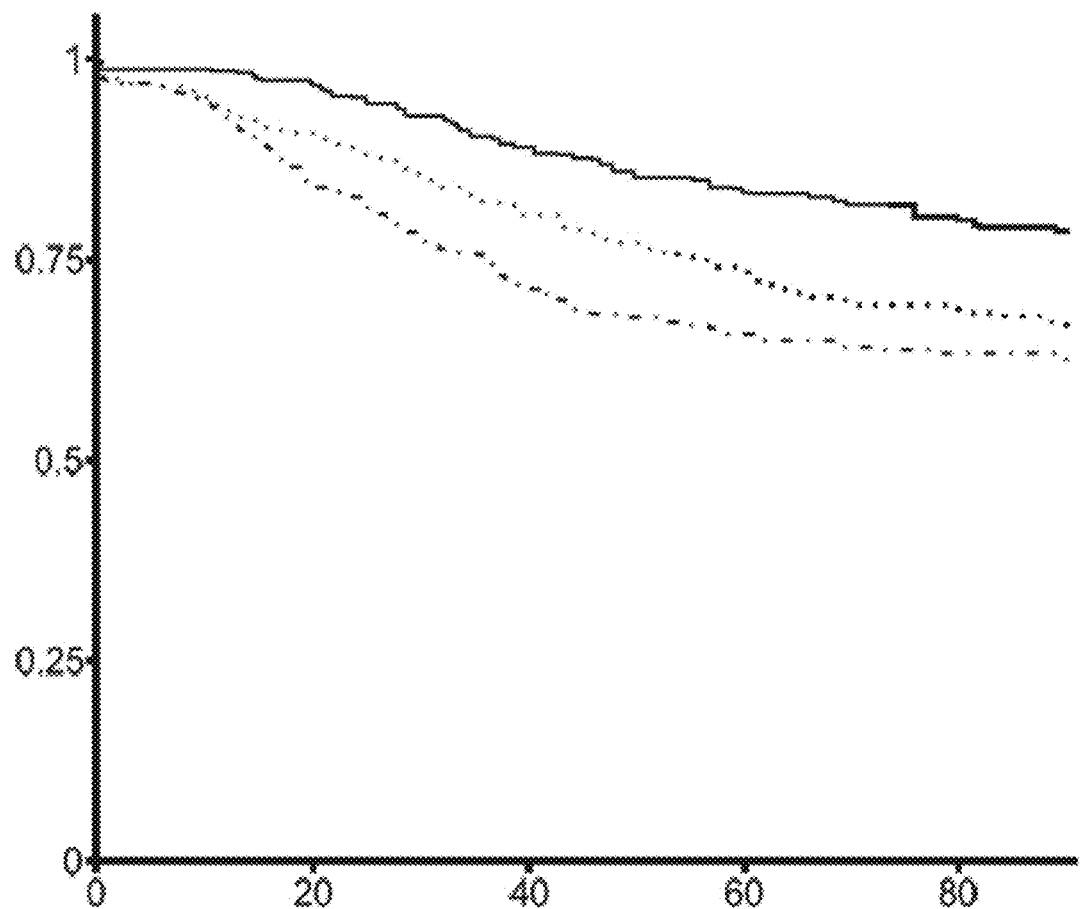
FIG. 17 shows a Kaplan-Meier plot of the disease free survival in breast cancer patients of E-MTAB-365, GSE20685 and GSE21653. The three patient groups are separated based on the tertiles of the $MPS_{probesets}$ risk score, which is a combination of the probesets associated with the selected target genes of the TGF-β pathway, the PI3K pathway, the Wnt pathway, the ER pathway, and the HH pathway. The difference between the survival curves of the high and low risk patients is clearly significant (log-rank test: p=1.3e-7).

Next the prognostic stratification of the risk scores of interests were analyzed using Kaplan-Meier plots in combination with the log-rank test. A simplistic algorithm is exemplarily used for the new risk scores described herein to stratify patients according to their risk score. The 1005 patients are divided into three equally sized groups (n=335) of increasing risk scores, i.e. the cutoffs are at the willies of the respective risk scores of all patients. Other variations of the risk stratification to the aforementioned method can be understood and effected by those skilled in the art using known optimization techniques. For example the Youden's J statistics can be used to infer risk thresholds. The risk stratification of the other risk scores included for comparison are performed as described by their inventors. That is, the activities of the TGF-β pathway, the PI3K pathway, the Wnt pathway, the ER pathway, and the HH pathway are used to stratify patients according to whether the respective pathway is either active, i.e., an activity of more than 0.5 on a scale from 0 to 1, or passive, i.e., an activity of 0.5 or less on a scale from 0 to 1. Patients with an $MPS_{ewh}$ of −0.1 or less are considered to be at low risk, patients with an $MPS_{ewh}$ higher or equal to 0.1 are considered to be at high risk, and all remaining patients (with an $MPS_{ewh}$ between −0.1 and 0.1) are considered to be at intermediate risk. On the other hand, patients with an RS less than 18 are considered to be at low risk, patients with an RS of 31 or higher are considered to be at high risk, and all remaining patients (with a RS between 18 and 31) are considered to be at intermediate risk. Kaplan-Meier plots are provided in FIGS. 2 to 9 for the new risk scores as described herein, that is, $MPS_{tp}$ (see FIG. 2), $MPS_{tw}$ (see FIG. 3), $MPS_{te}$ (see FIG. 4), $MPS_{th}$ (see FIG. 5), $MPS_{tpw}$ (see FIG. 6), $MPS_{tpe}$ (see FIG. 7), $MPS_{tph}$ (see FIG. 8), $MPS_{twe}$ (see FIG. 9), $MPS_{twh}$ (see FIG. 10), $MPS_{teh}$ (see FIG. 11), $MPS_{tpwe}$ (see FIG. 12), $MPS_{tpwh}$ (see FIG. 13), $MPS_{tpch}$ (see FIG. 14), $MPS_{tweh}$ (see FIG. 15), $MPS_{tpwch}$ (see FIG. 16), and $MPS_{probesets}$ (see FIG. 17). In these graphs, the vertical axis indicates the recurrence free survival as a fraction of the patient group and the horizontal axis indicates a time in years. The low, intermediate and high risk groups (each 335 patients) are depicted with solid (characteristically the upper), dotted (characteristically the middle), and dashed-dotted (characteristically the lower) line, respectively. These plots show a clear discrimination of the risk that a subject might experience a clinical event within a certain period of time between the different groups. This difference in risk stratification can be quantized by means of the log-rank test. Here it was chosen to compare the Kaplan-Meier curve of the highest risk group vs. the lowest risk group (in case of the individual pathway activities this is active vs. passive). The log-rank p-values are depicted in the last column of Table 23. The Kaplan-Meier plots and associated log-rank statistics further exemplify the advantage of the risk scores including the activity of the TGF-β pathway and the activity of one further cellular signaling pathway, as they can be used to stratify patients at lower or higher risk of disease recurrence.

Figure 18:
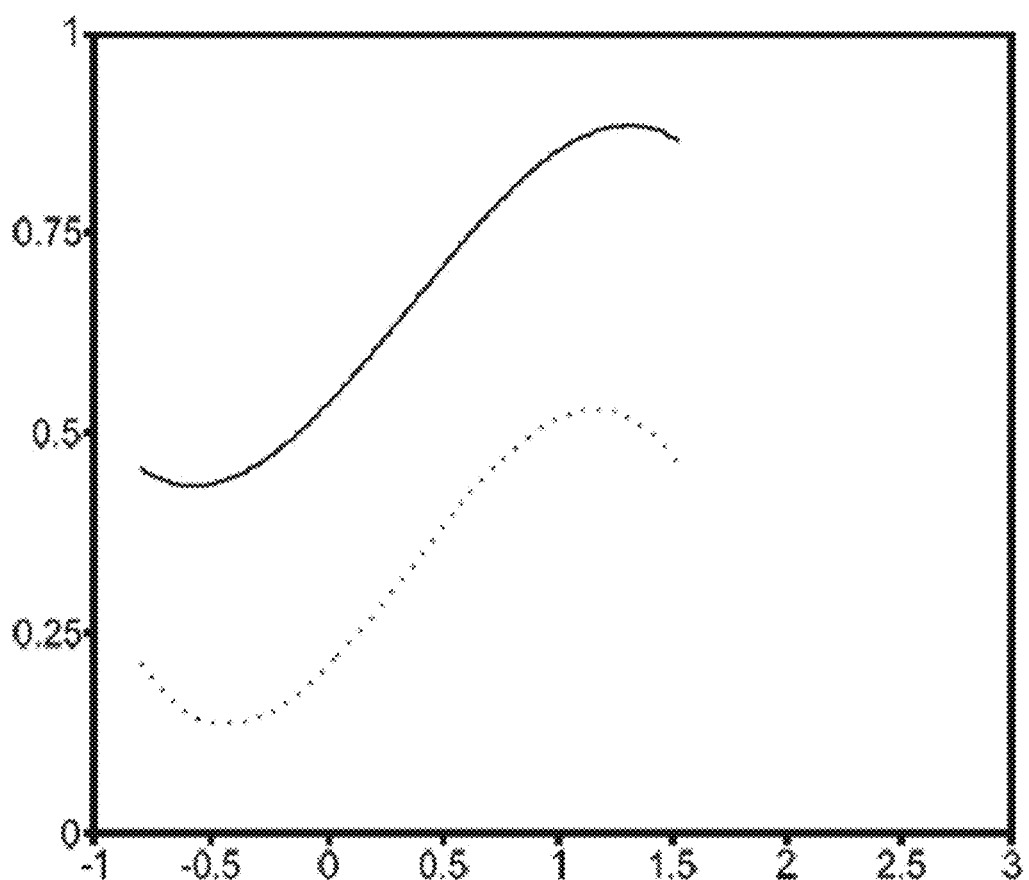
FIG. 18 shows the likelihood of disease free survival at five (lower, dotted line) and ten years (upper, solid line) using the unsealed $MPS_{tpweh}$ as example.

FIG. 18 shows the likelihood of disease free survival at five (solid line) and ten years (dotted lines) using the unsealed $MPS_{tpwech}$ as example. The piecewise curve shows a strong (monotonic) increase in likelihood/risk between the values −0.4 and 1.2, below and above these values the risk seems to level off, hence it would make sense to place cutoffs near these values. Furthermore, for ease of use of the user the multi-pathway scores could be resealed to start at zero and range up to a certain positive number, e.g. a score between 0 and 15 or 0 and 100, instead of covering a range including negative values. For example a resealed $MPS_{tpweh}$ including these thresholds could look like this:

$$MPS^{sc}_{tpweh} = \begin{cases} 0 & 60(MPS_{tpweh} + 0.5) < 0 \\ 60(MPS_{tpweh} + 0.5) & 0 \leq 60(MPS_{tpweh} + 0.5) \leq 100 \\ 100 & 60(MPS_{tpweh} + 0.5) > 100 \end{cases} \quad 23)$$

The $MPS_{tp}$, $MPS_{tw}$, $MPS_{te}$, $MPS_{th}$, $MPS_{tpw}$, $MPS_{tpe}$, $MPS_{tph}$, $MPS_{twe}$, $MPS_{twh}$, $MPS_{teh}$, $MPS_{tpwe}$, $MPS_{tpwh}$, $MPS_{tpeh}$, $MPS_{tweh}$, $MPS_{tpweh}$ and $MPS_{probesets}$ risk scores trained on the initial training set of breast cancer patients in GSE6532 and GSE9195 were shown to generalize well on other datasets of breast cancer samples. Alternatively, the risk scores can be trained on the previously described datasets, i.e., GSE6532, GSE9195, E-MTAB-365, GSE20685 and GSE21653 simultaneously (in total 1169 patients with survival data) using the estimated Cox's coefficients as discussed previously. This results in the following risk scores:

$$MPS_{tp} = 1.27(\pm 0.21) \cdot P_t + 0.70(\pm 0.17) \cdot P_p \quad 24)$$

$$MPS_{tw} = 1.27(\pm 0.21) \cdot P_t + 0.38(\pm 0.26) \cdot P_w \quad 25)$$

$$MPS_{te} = 1.27(\pm 0.21) \cdot P_t + (-0.87(\pm 0.18)) \cdot P_e \quad 26)$$

$$MPS_{th} = 1.27(\pm 0.21) \cdot P_t + 0.90(\pm 0.20) \cdot P_h \quad 27)$$

$$MPS_{tpw} = 1.27(\pm 0.21) \cdot P_t + 0.70(\pm 0.17) \cdot P_p + 0.38(\pm 0.26) \cdot P_w \quad 28)$$

$$MPS_{tpe} = 1.27(\pm 0.21) \cdot P_t + 0.70(\pm 0.17) \cdot P_p + (-0.87(\pm 0.18)) \cdot P_e \quad 29)$$

$$MPS_{tph} = 1.27(\pm 0.21) \cdot P_t + 0.70(\pm 0.17) \cdot P_p + 0.90(\pm 0.90) \cdot P_h \quad 30)$$

$$MPS_{twe} = 1.27(\pm 0.21) \cdot P_t + 0.38(\pm 0.26) \cdot P_w + (-0.87(\pm 0.18)) \cdot P_e \quad 31)$$

$$MPS_{twh} = 1.27(\pm 0.21) \cdot P_t + 0.38(\pm 0.26) \cdot P_w + 0.90(\pm 0.20) \cdot P_h \quad 32)$$

$$MPS_{teh} = 1.27(\pm 0.21) \cdot P_t + (-0.87(\pm 0.18)) \cdot P_e + 0.90(\pm 0.20) \cdot P_h \quad 33)$$

$$MPS_{tpwe} = 1.27(\pm 0.21) \cdot P_t + \\ 0.70(\pm 0.17) \cdot P_p + 0.38(\pm 0.26) \cdot P_w + (-0.87(\pm 0.18)) \cdot P_e \quad 34)$$

$$MPS_{tpwh} = 1.27(\pm 0.21) \cdot P_t + \qquad 35)$$
$$0.70(\pm 0.17) \cdot P_p + 0.38(\pm 0.26) \cdot P_w + 0.90(\pm 0.20) \cdot P_h$$

$$MPS_{tpeh} = 1.27(\pm 0.21) \cdot P_t + \qquad 36)$$
$$0.70(\pm 0.17) \cdot P_p + (-0.87(\pm 0.18)) \cdot P_e + 0.90(\pm 0.20) \cdot P_h$$

$$MPS_{tweh} = 1.27(\pm 0.21) \cdot P_t + \qquad 37)$$
$$0.38(\pm 0.26) \cdot P_w + (-0.87(\pm 0.18)) \cdot P_e + 0.90(\pm 0.20) \cdot P_h$$

$$MPS_{tpweh} = 1.27(\pm 0.21) \cdot P_t + 0.70(\pm 0.17) \cdot P_p + \qquad 38)$$
$$0.38(\pm 0.26) \cdot P_w + (-0.87(\pm 0.18)) \cdot P_e + 0.90(\pm 0.20) \cdot P_h$$

Alternatively, the coefficients of the risk scores can be determined by combining the Cox's coefficients estimated on the datasets independently. The independently determined Cox's coefficients together with their standard error are used to estimate the true coefficient for the activity of each pathway using maximum likelihood estimation. The patients of both datasets from the Guy's hospital, GSE6532 and GSE9195, were combined into one training dataset due to their small size. The most likely coefficients' values were determined by weighting the individually determined coefficient estimates with the number of patients included in the dataset over the standard error of the coefficient estimate:

$$\underset{\hat{b}}{\operatorname{argmin}} \sum_{i \in datasets} n_i \left( \frac{\hat{b} - b_i}{\sigma_i} \right)^2 \qquad 39)$$

wherein $n_i$ is the number of patients included in dataset i, $\hat{b}$ is the estimator of the true coefficient value, $b_i$ is the Cox's coefficient of dataset i and $\sigma_i$ is the standard error of the Cox's coefficient estimated from dataset i. This minimization was performed for the activity, of the TGF-β pathway, the PI3K pathway, the Wnt pathway, the ER pathway, and the HH pathway, respectively. The variances of the true coefficient estimates were determined using the Fisher information matrix. Using these values to parameterize the aforementioned linear combinations of pathway activities result in the following risk scores:

$$MPS_{tp} = 1.20(\pm 0.11) \cdot P_t + 0.72(\pm 0.16) \cdot P_p \qquad 40)$$

$$MPS_{tw} = 1.20(\pm 0.11) \cdot P_t + 0.19(\pm 0.14) \cdot P_w \qquad 41)$$

$$MPS_{te} = 1.20(\pm 0.11) \cdot P_t + (-0.83(\pm 0.07)) \cdot P_e \qquad 42)$$

$$MPS_{th} = 1.20(\pm 0.11) \cdot P_t + 0.75(\pm 0.18) \cdot P_h \qquad 43)$$

$$MPS_{tpw} = 1.20(\pm 0.11) \cdot P_t + 0.72(\pm 0.16) \cdot P_p + 0.19(\pm 0.14) \cdot P_w \qquad 44)$$

$$MPS_{tpe} = 1.20(\pm 0.11) \cdot P_t + 0.72(\pm 0.16) \cdot P_p + (-0.83(\pm 0.07)) \cdot P_e \qquad 45)$$

$$MPS_{tph} = 1.20(\pm 0.11) \cdot P_t + 0.72(\pm 0.16) \cdot P_p + 0.75(\pm 0.18) \cdot P_h \qquad 46)$$

$$MPS_{twe} = 1.20(\pm 0.11) \cdot P_t + 0.19(\pm 0.14) \cdot P_w + (-0.83(\pm 0.07)) \cdot P_e \qquad 47)$$

$$MPS_{twh} = 1.20(\pm 0.11) \cdot P_t + 0.19(\pm 0.14) \cdot P_w + 0.75(\pm 018) \cdot P_h \qquad 48)$$

$$MPS_{teh} = 1.20(\pm 0.11) \cdot P_t + (-0.85(\pm 0.06)) \cdot P_e + 0.75(\pm 018) \cdot P_h \qquad 49)$$

$$MPS_{tpwe} = 1.20(\pm 0.11) \cdot P_t + \qquad 50)$$
$$0.72(\pm 0.16) \cdot P_p + 0.19(\pm 0.14) \cdot P_w + (-0.83(\pm 0.07)) \cdot P_e$$

$$MPS_{tpwh} = 1.20(\pm 0.11) \cdot P_t + \qquad 51)$$
$$0.72(\pm 0.16) \cdot P_p + 0.19(\pm 0.14) \cdot P_w + 0.75(\pm 0.18) \cdot P_h$$

$$MPS_{tpeh} = 1.20(\pm 0.11) \cdot P_t + \qquad 52)$$
$$0.72(\pm 0.16) \cdot P_p + (-0.83(\pm 0.07)) \cdot P_e + 0.75(\pm 0.18) \cdot P_h$$

$$MPS_{tweh} = 1.20(\pm 0.11) \cdot P_t + \qquad 53)$$
$$0.19(\pm 0.14) \cdot P_w + (-0.83(\pm 0.07)) \cdot P_e + 0.75(\pm 0.18) \cdot P_h$$

$$MPS_{tpweh} = 1.20(\pm 0.11) \cdot P_t + 0.72(\pm 0.16) \cdot P_p + \qquad 54)$$
$$0.19(\pm 0.14) \cdot P_w + (-0.83(\pm 0.07)) \cdot P_e + 0.75(\pm 0.18) \cdot P_h$$

Example 3: CDS Application

With reference to FIG. 19 (diagrammatically showing a clinical decision support (CDS) system configured to determine a risk score that indicates a risk that a subject will experience a clinical event within a certain period of time, as disclosed herein), a clinical decision support (CDS) system 10 is implemented as a suitably configured computer 12a. The computer 12a may be configured to operate as the CDS system 10 by executing suitable software, firmware, or other instructions stored on a non-transitory storage medium (not shown), such as a hard drive or other magnetic storage medium, an optical disk or another optical storage medium, a random access memory (RAM), a read-only memory (ROM), a flash memory, or another electronic storage medium, a network server, or so forth. While the illustrative CDS system 10 is embodied by the illustrative computer 12a, more generally the CDS system may be embodied by a digital processing device or an apparatus comprising a digital processor configured to perform clinical decision support methods as set forth herein. For example, the digital processing device may be a handheld device (e.g., a personal data assistant or smartphone running a CDS application), a notebook computer, a desktop computer, a tablet computer or device, a remote network server, or so forth. The computer 12a or other digital processing device typically includes or is operatively connected with a display device 14a via which information including clinical decision support recommendations are displayed to medical personnel. The computer 12a or other digital processing device typically also includes or is operatively connected with one or more user input devices, such as an illustrative keyboard 16a, or a mouse, a trackball, a trackpad, a touch-sensitive screen (possibly integrated with the display device 14a), or another pointer-based user input device, via which medical personnel can input information such as operational commands for controlling the CDS system 10, data for use by the CDS system 10, or so forth.

The CDS system 10 receives as input information pertaining to a subject (e.g., a hospital patient, or an outpatient being treated by an oncologist, physician, or other medical personnel, or a person undergoing cancer screening or some other medical diagnosis who is known or suspected to have a certain type of cancer, such as colon cancer, breast cancer, or liver cancer, or so forth). The CDS system 10 applies various data analysis algorithms to this input information in order to generate clinical decision support recommendations that are presented to medical personnel via the display device 14a (or via a voice synthesizer or other device providing human-perceptible output). In some embodiments, these algorithms may include applying a clinical guideline to the patient. A clinical guideline is a stored set of standard or "canonical" treatment recommendations, typically constructed based on recommendations of a panel of medical experts and optionally formatted in the form of a clinical "flowchart" to facilitate navigating through the clinical guideline. In various embodiments the data processing algorithms of the CDS 10 may additionally or alternatively include various diagnostic or clinical test algorithms that are performed on input information to extract clinical decision recommendations, such as machine learning methods disclosed herein.

In the illustrative CDS systems disclosed herein (e.g., CDS system 10), the CDS data analysis algorithms include one or more diagnostic or clinical test algorithms that are performed on input genomic and/or proteomic information acquired by one or more medical laboratories 18a. These laboratories may be variously located "on-site", that is, at the hospital or other location where the subject is undergoing medical examination and/or treatment, or "off-site", e.g., a specialized and centralized laboratory that receives (via mail or another delivery service) a sample of the subject that has been extracted from the subject (e.g., a sample obtained from a cancer lesion, or from a lesion suspected for cancer, or from a metastatic tumor, or from a body cavity in which fluid is present which is contaminated with cancer cells (e.g., pleural or abdominal cavity or bladder cavity), or from other body fluids containing cancer cells, and so forth, for example, via a biopsy procedure or other sample extraction procedure). The cells of which a sample is extracted may also be tumorous cells from hematologic malignancies (such as leukemia or lymphoma). In some cases, the cell sample may also be circulating tumor cells, that is, tumor cells that have entered the bloodstream and may be extracted using suitable isolation techniques, e.g., apheresis or conventional venous blood withdrawal. Aside from blood, the body fluid of which a sample is extracted may be urine, gastrointestinal contents, or an extravasate.

The sample is processed by the laboratory to generate genomic or proteomic information. For example, the sample may be processed using a microarray (also variously referred to in the art as a gene chip, DNA chip, biochip, or so forth) or by quantitative polymerase chain reaction (qPCR) processing to measure probative genomic or proteomic information such as expression levels of genes of interest, for example in the form of a level of messenger ribonucleic acid (mRNA) that is transcribed from the gene, or a level of a protein that is translated from the mRNA transcribed from the gene. As another example, the sample may be processed by a gene sequencing laboratory to generate sequences for deoxyribonucleic acid (DNA), or to generate an RNA sequence, copy number variation, methylation, or so forth. Other contemplated measurement approaches include immunohistochemistry (IHC), cytology, fluorescence in situ hybridization (FISH), proximity ligation assay or so forth, performed on a pathology slide. Other information that can be generated by microarray processing, mass spectrometry, gene sequencing, or other laboratory techniques includes methylation information. Various combinations of such genomic and/or proteomic measurements may also be performed.

In some embodiments, the medical laboratories 18a perform a number of standardized data acquisitions on the sample of the subject, so as to generate a large quantity of genomic and/or proteomic data. For example, the standardized data acquisition techniques may generate an (optionally aligned) DNA sequence for one or more chromosomes or chromosome portions, or for the entire genome. Applying a standard microarray can generate thousands or tens of thousands of data items such as expression levels for a large number of genes, various methylation data, and so forth. Similarly, PCR-based measurements can be used to measure the expression level of a selection of genes. This plethora of genomic and/or proteomic data, or selected portions thereof, are input to the CDS system 10 to be processed so as to develop clinically useful information for formulating clinical decision support recommendations.

The disclosed CDS systems and related methods relate to processing of genomic and/or proteomic data to assess activity of various cellular signaling pathways and to determine a risk score that indicates a risk that a subject will experience a clinical event (e.g., cancer) within a certain period of time. However, it is to be understood that the disclosed CDS systems (e.g., CDS system 10) may optionally further include diverse additional capabilities, such as generating clinical decision support recommendations in accordance with stored clinical guidelines based on various patient data such as vital sign monitoring data, patient history data, patient demographic data (e.g., gender, age, or so forth), patient medical imaging data, or so forth. Alternatively, in some embodiments the capabilities of the CDS system 10 may be limited to only performing genomic and/or proteomic data analyses to assess the activity of cellular signaling pathways and to determine a risk score that indicates a risk that a subject will experience a clinical event (e.g., cancer) within a certain period of time, as disclosed herein.

With continuing reference to exemplary FIG. 19, the CDS system 10 infers activity 22 of one or more cellular signaling pathways, here, the TGF-β pathway and one or more of the PI3K pathway, the Wnt pathway, the ER pathway, and the HH pathway, in the subject based at least on, but not restricted to, the expression levels 20a of one or more target gene(s) of the cellular signaling pathways measured in the sample of the subject. The TGF-β pathway, the PI3K pathway, the Wnt pathway, the ER pathway, and the HH pathway are of interest in various areas of oncology because loss of regulation of these pathways can be a cause of proliferation of a cancer. There are about 10 to 15 relevant signaling pathways, and each cancer is driven by at least one dominant pathway being deregulated. Without being limited to any particular theory of operation these pathways regulate cell proliferation, and consequentially a loss of regulation of these pathways in cancer cells can lead to the pathway being "always on" thus accelerating the proliferation of cancer cells, which in turn manifests as a growth, invasion or metastasis (spread) of the cancer.

Measurement of mRNA expression levels of genes that encode for regulatory proteins of the cellular signaling pathway, such as an intermediate protein that is part, of a protein cascade forming the cellular signaling pathway, is an indirect measure of the regulatory protein expression level and may or may not correlate strongly with the actual regulatory protein expression level (much less with the overall activity of the cellular signaling pathway). The cellular signaling pathway directly regulates the transcription of the target genes hence, the expression levels of snRNA transcribed from the target genes is a direct result of this regulatory activity. Hence, the CDS system 10 infers activity of the one or more cellular signaling pathways (here, the TGF-β pathway and one or more of the PI3K pathway, the Wnt pathway, the ER pathway, and the HH pathway) based at least on expression levels of one or more target gene(s) (mRNA or protein level as a surrogate measurement) of the cellular signaling pathways. This ensures that the CDS system 10 infers the activity of the pathway based on direct information provided by the measured expression levels of the target gene(s).

The inferred activities, in this example, $P_t$, $P_p$, $P_w$, $P_e$ and $P_h$, i.e., the inferred activities of the TGF-β pathway, the PI3K pathway, the Wnt pathway, the ER pathway, and the HH pathway, are then used to determine 24 a risk score that indicates a risk that the subject will experience the clinical event, in this example, cancer, in particular, breast cancer, within a certain period of time, as described in detail herein. The risk score is based at least in part on a combination of the inferred activities. For example, the risk score may be the "Multi-Pathway Score" (MPS) calculated as described in detail with reference to Eq. (4) or (5).

Based on the determined MPS, the CDS system 10, in this example, assigns 26 the subject to at least one of a plurality of risk groups associated with different indicated risks that the subject will experience the clinical event within the certain period of time, and/or decides 28 a treatment recommended for the subject based at least in part on the indicated risk that the subject will experience the clinical event within the certain period of time.

Determining the MPS and/or the risk classification for a particular patient by the CDS system or a standalone implementation of the MPS and risk classification as described herein will enable the oncologist, physician, or other medical personnel involved in diagnosis or treatment or monitoring/follow-up of the patient to tailor the treatment such that the patient has the best chance of long term survival while unwanted side-effects, especially those of aggressive chemotherapy and/or targeted therapy and/or immunotherapy and/or radiotherapy and/or surgery, are minimized. Thus, e.g., patients with a low risk of cancer recurrence, i.e., those with a low MPS and/or those classified as low risk based on the risk stratification algorithm as described herein, are currently typically treated with hormone treatment alone or a combination of hormone treatment, for example anti-estrogen and/or aromatase inhibitors, and a less toxic chemotherapeutic agent. On the other hand, patients with an intermediate or high risk of cancer recurrence, i.e., those with a medium to high MPS and/or those classified as intermediate or high risk based on the risk stratification algorithm as described herein, will currently typically be treated with more aggressive chemotherapy, such as anthracycline and/or taxane-based treatment regimes. In addition, the MPS, possibly in combination with other patient's test results and/or results from other prognostic or predictive (e.g., companion diagnostic) tests, can give rise to a decision to treat the patient with targeted drugs such as Tamoxifen, Trastuzumab, Bevacizumab, and/or other therapeutic drugs (for example immunotherapy) that are currently not part of the main line treatment protocol for the patient's particular cancer, and/or other treatment options, such as radiation therapy, for example brachytherapy, and/or different timings for treatment, for example before and/or after primary treatment.

It is noted that instead of directly using the determined risk score (MPS) as an indication of the risk that the subject will experience a clinical event (e.g., cancer) within the certain period of time, it is possible that the CDS system 10 is configured to combine the risk score with one or more additional risk scores obtained from one or more additional prognostic tests to obtain a combined risk score, wherein the combined risk score indicates a risk that the subject will experience the clinical event within the certain period of time. The one or more additional prognostic tests may comprise, in particular, the Oncotype DX® breast cancer test, the Mammostrat® breast cancer test, the MammaPrint® breast cancer test, the EndoPredict® breast cancer test, the BluePrint™ breast cancer test, the CompanDx® breast cancer test, the Breast Cancer Index$^{SM}$ (HOXXB13/I117BR), the OncotypeDX® colon cancer test, and/or a proliferation test performed by measuring expression of gene/protein Ki67.

Example 4: A Kit and Analysis Tools to Determine a Risk Score

The set of target genes which are found to best indicate the activity of the respective cellular signaling pathway, based on microarray/RNA sequencing based investigation using, e.g., the Bayesian model or the (pseudo-)linear model, can be translated into for example a multiplex quantitative PCR assay or dedicated microarray biochips to be performed on a sample of a subject. A selection of the gene sequence as described herein can be used to select for example a primer-probe set for RT-PCR or oligonucleotides for microarray development. To develop such an FDA-approved test for pathway activity and risk score determination, development of a standardized test kit is required, which needs to be clinically validated in clinical trials to obtain regulatory approval.

This application describes several embodiments. Modifications and alterations may occur to others upon reading and understanding the preceding detailed description. It is intended that the application is construed as including all such modifications and alterations insofar as they come within the scope of the appended claims or the equivalents thereof.

Other variations to the disclosed embodiments can be understood and effected by those skilled in the art in practicing the claims, from a study of the drawings, the disclosure, and the appended claims.

In the claims, the word "comprising" does not exclude other elements or steps, and the indefinite article "a" or "an" does not exclude a plurality.

A single unit or device may fulfill the functions of several items recited in the claims. The mere fact that certain measures are recited in mutually different dependent claims does not indicate that a combination of these measures cannot be used to advantage.

Calculations like the determination of the risk score performed by one or several units or devices can be performed by any other number of units or devices.

A computer program may be stored/distributed on a suitable medium, such as an optical storage medium or a solid-state medium, supplied together with or as part of other hardware, but may also be distributed in other forms, such as via the Internet or other wired or wireless telecommunication systems.

Any reference signs in the claims should not be construed as limiting the scope.

The present application mainly relates to specific method for determining a risk score that indicates a risk that a clinical event will occur within a certain period of time, wherein the risk score is based at least in part on a combination of inferred activities of two or more cellular signaling pathways in a subject, wherein the cellular signaling pathways comprise a TGF-β pathway and one or more of a PI3K pathway, a Wnt pathway, an ER pathway, and an HH pathway. The present application also relates to an apparatus comprising a digital processor configured to perform such methods, to a non-transitory storage medium storing instructions that are executable by a digital processing device to perform such methods, and to a computer program comprising program code means for causing a digital processing device to perform such methods. The present disclosure also relates to a signal representing a risk score.

Example 5: Application in Breast Cancer Subtypes

Figure 24A:
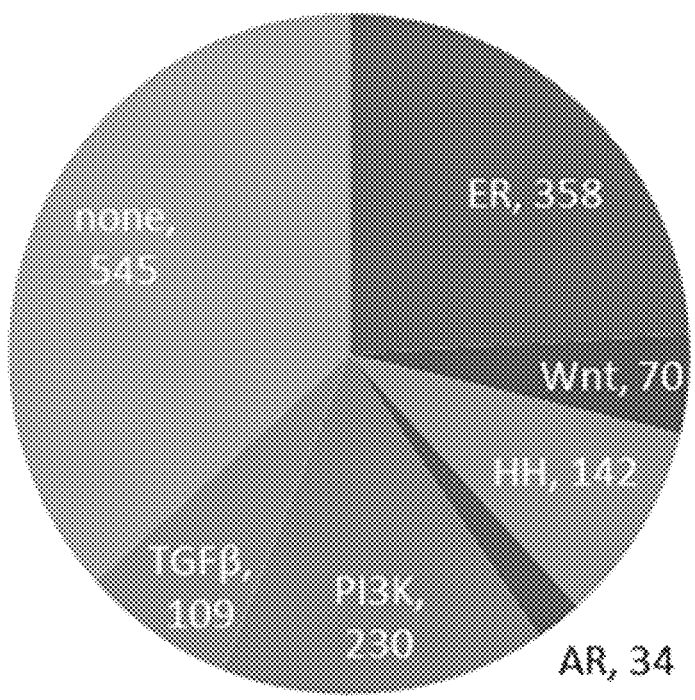
FIG. 24A shows the distribution of active (P>0.5) pathways in 1294 breast cancer samples. The sum of active pathways exceeds the total number of patients as they can have multiple pathways found to be active in their sample.
Figure 24B:
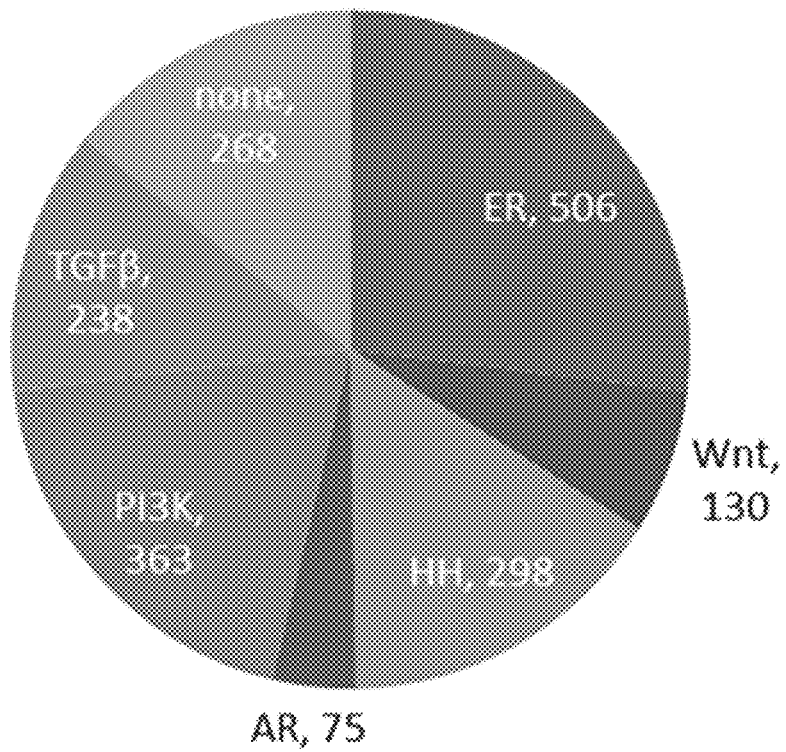
FIG. 24B shows the distribution of marginally active (P>0.2) pathways in 1294 breast cancer samples. The sum of active pathways exceeds the total number of patients as they can have multiple pathways found to be active in their sample.

To assess pathway activity for each breast cancer subtype the pathway models for ER, AR, Wnt, HH, TGF-β and the PI3K, pathway were tested individually on Affymetrix HG-U133 Plus 2.0, microarray data from 1294 breast cancer tissue samples from public data sets GSE6532. GSE9195, GSE20685. GSE21653 and E-MTAB-365. The various breast cancer subtypes were characterized by different distributions of active pathways (FIGS. 24A and B). Out of the 1294 breast cancer samples, 749 (58%) had at least one pathway active, which is defined as having an inferred probability that the TF complex is actively present above 0.5 (FIG. 24A). With a lower the threshold to 0.2, which is defined as marginal probability of the pathway being active, or as a marginally active pathway, 1026 (79%) patients had at least one marginally active pathway (FIG. 24B). Forty-one percent (n=537) of the patients had at least the ER or PI3K pathway active. HH, TGF-β and Wnt active samples were found less frequently, in 11% (n=142), 8.4% (n=109) and 5.4% (n=70) of the patients, respectively (FIG. 24B). Only a small fraction of 2.6% (n=34) patients were found to have an active AR pathway.

Intrinsic subtypes were determined using the methodology as described by Parker and co-workers (Supervised risk predictor of breast cancer based on intrinsic subtypes. Parker J S, et al., 2009, J Clin Oncol, Vol. 27, pp. 1160–1167.). IRMA-normalized gene expression of all 50 genes included in the PAM50 was extracted from the microarray data using the probesets associated with the PAM50-genes. The probeset with the highest variance was selected in case more than one probeset was associated with a single gene. Centroids for the luminal A, luminal B, HER2 enriched, basal and normal-likes were calculated using the samples from GSE21653 with known subtypes. Next. Pearson's correlation coefficients with these centroids were calculated for all samples. Each sample was assigned to the subtype with the highest correlation.

Figure 25A:
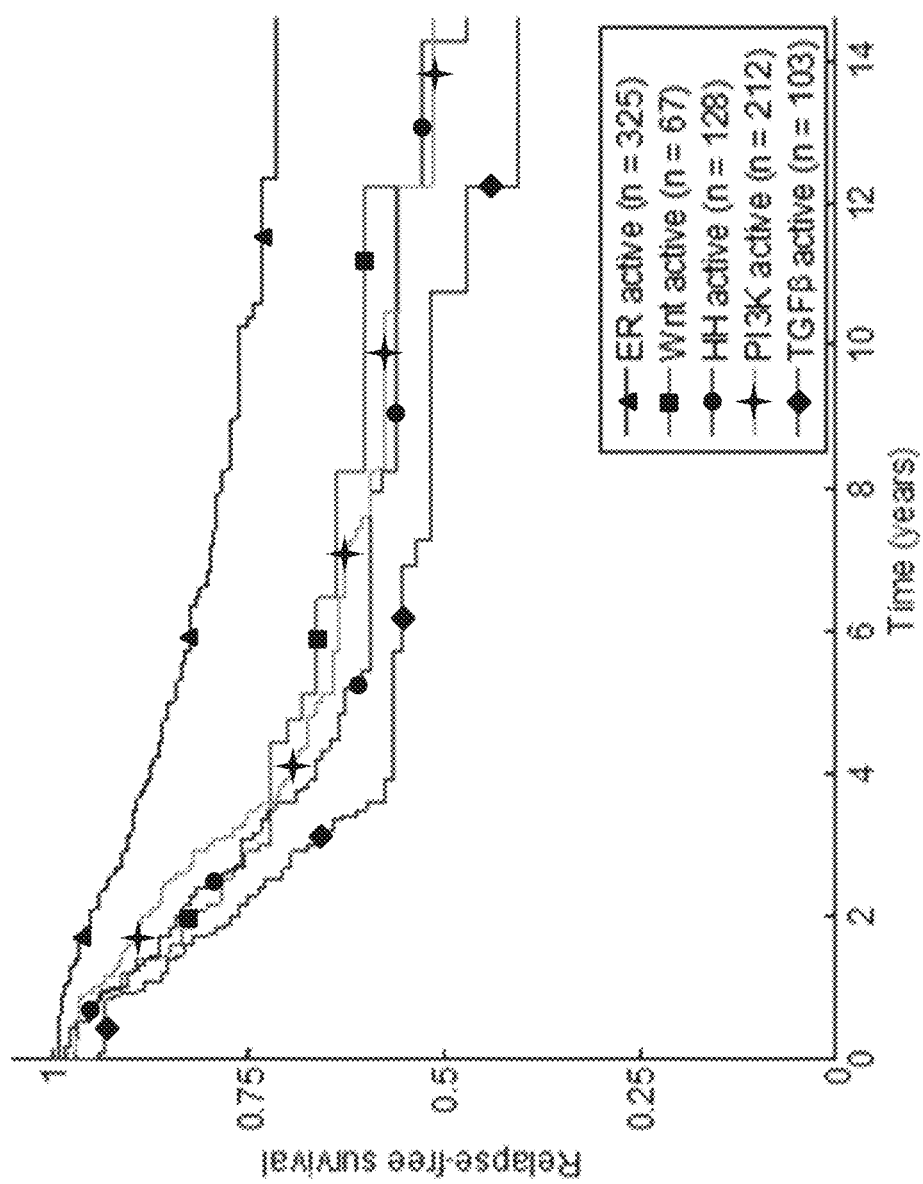
FIG. 25A shows a Kaplan-Meier plot of the relapse-free survival of 1169 breast cancer patients divided according to pathway activity.
Figure 26:
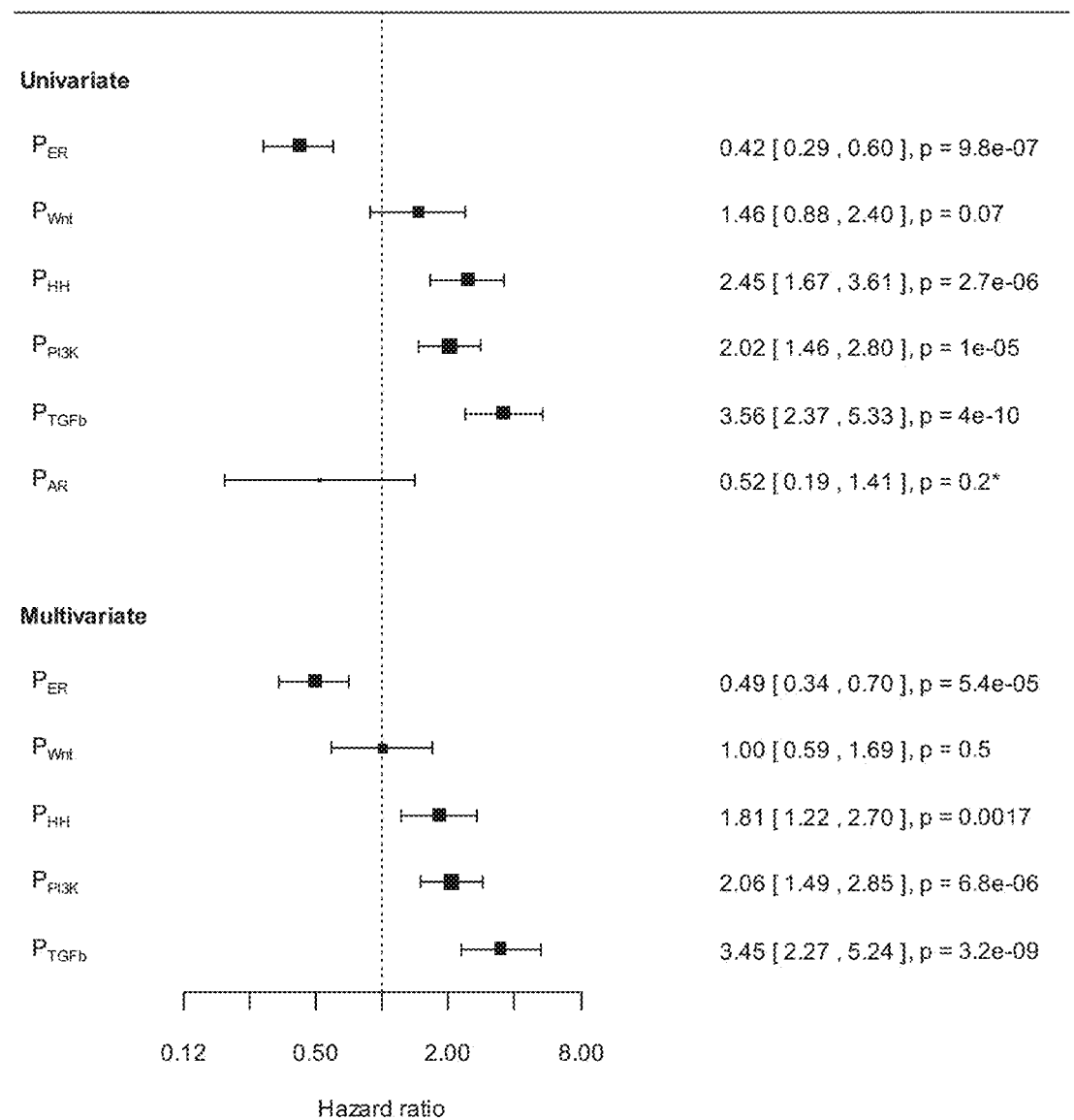
FIG. 26 shows the univariate and multivariate Cox regression of relapse-free survival of 1169 patients the p-value of PAR is two-sided.

Survival analyses using Kaplan-Meier curves and univariate Cox regression showed that ER, Wnt, PI3K and TGF-β pathway activities are associated with relapse-free survival, assessed on the 1169 breast cancer patients (FIG. 25A and FIG. 26).

Relapse-free survival was relatively highest in ER active patients (FIGS. 25A and B), whereas patients with an active TGF-β pathway relapsed considerably sooner (3-year relapse-free survival: 67.5% vs. 90.4%, log-rank test: 5.4e-10). Also patients with activity of the other embryonic signaling pathways, HH and Wnt as well as the PI3K survival pathway had a significantly worse prognosis compared to ER active patients (log-rank test, p=: 2.2e-6, 1.1e-3 and 2.1e-6, respectively). Patients in which none of these five pathways were found to be active had a reasonable good prognosis, though worse compared to ER active patients.

Next, the relation between pathway probability and relapse-free survival was further assessed by Cox regression. Univariate Cox regression analysis on the pathway activity probabilities identified the ER pathway as most favorable activity, while Wnt, HH, PI3K. and TGF-β activity were associated with worse prognosis (FIG. 26). Probability of the AR pathway could not be clearly defined as either favorable or detrimental with respect to relapse-free survival (p=0.2, two-sided). Probability of the ER, HH, PI3K and TGF-β pathways remained significant predictors of relapse in a multivariate analysis with ER, Wnt, HH, PI3K and TGF-β, whereas Wnt loses its significance if combined with other pathways (FIG. 26).

Figure 27:
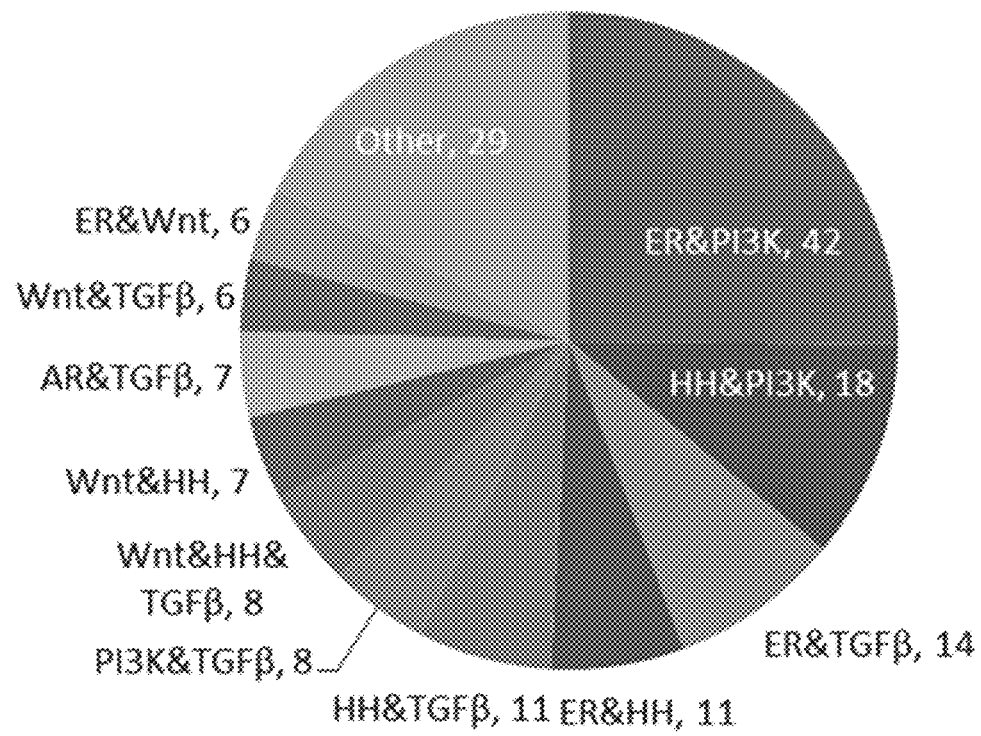
FIG. 27 shows the prevalence frequency of combinations of active pathways in 167 of 1294 (13%) breast cancer patient samples with at least two active pathways.

In 167 (13%) patient samples, at least two pathways were found to be active. The most prevalent combination consists of active ER and PI3K pathways (FIG. 27). Combinations of active ER or PI3K with one or more embryonic pathways were also among the most prevalent combinations, for example the combination of HH and PI3K was observed 18 times. In a smaller percentage of samples two embryonic pathways were found active in various combinations. The sample numbers were however too small to identify predictive prognostic value associated with these pathway combinations.

Figure 25B:
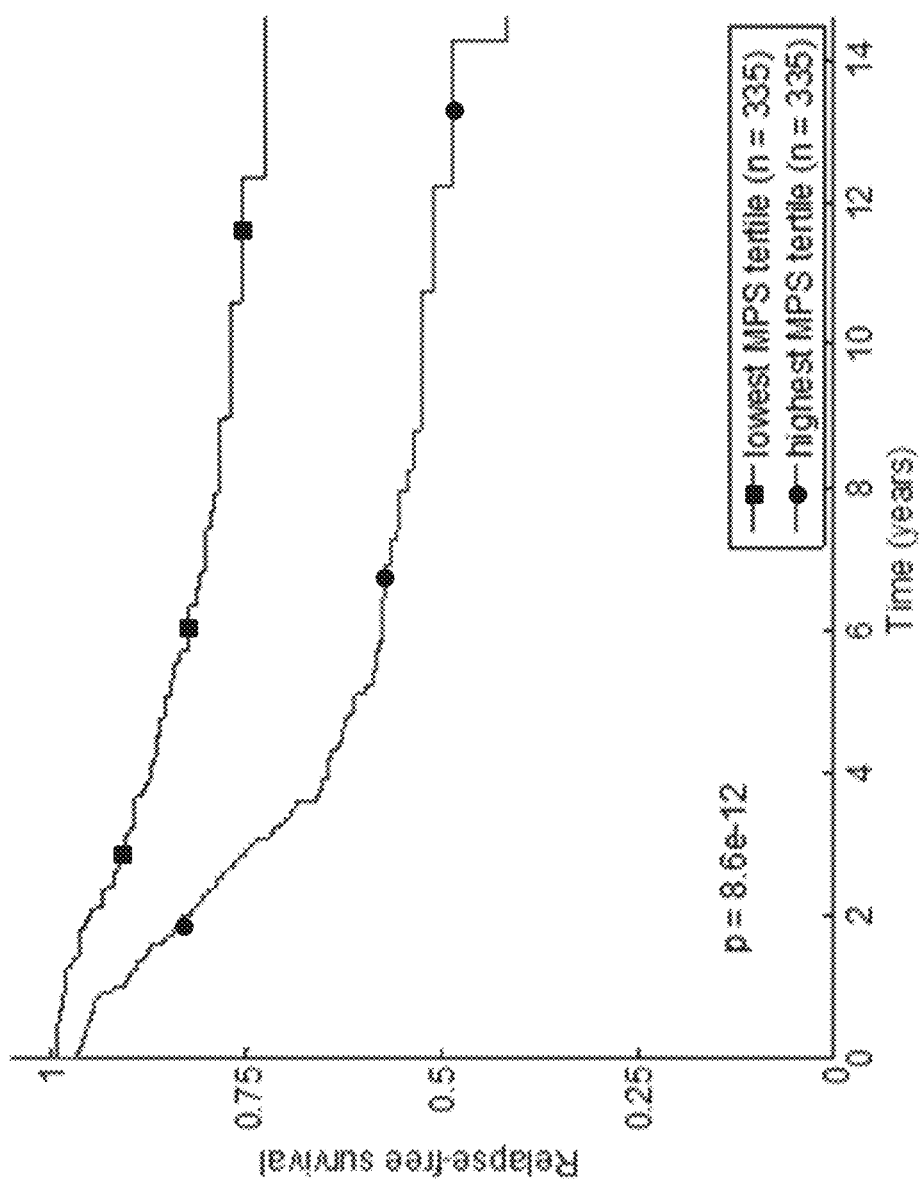
FIG. 25B shows a Kaplan-Meier plot the relapse-free survival of 1169 breast cancer patients divided according to higher (circle) and lower (square) tertiles of the MPS.
Figure 28A:
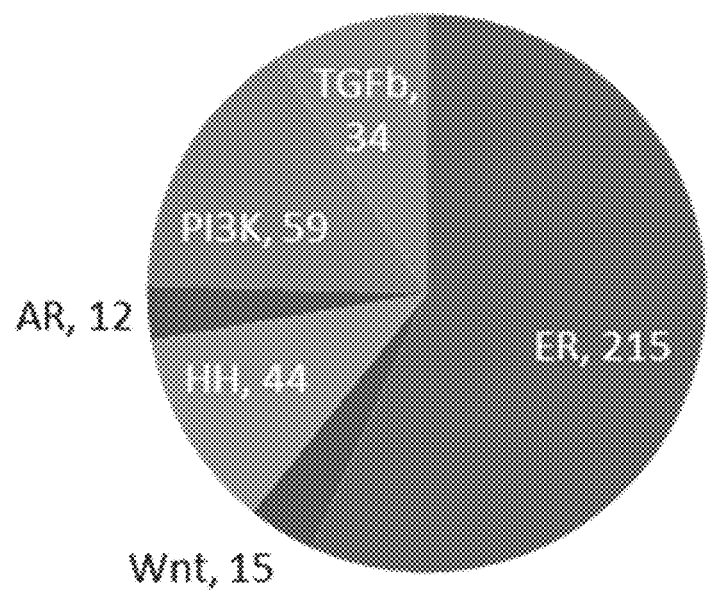
FIG. 28A shows the distribution of pathway activity over breast cancer subtypes according to the intrinsic subtypes of the PAM50 algorithm for the Luminal A subtype.
Figure 28B:
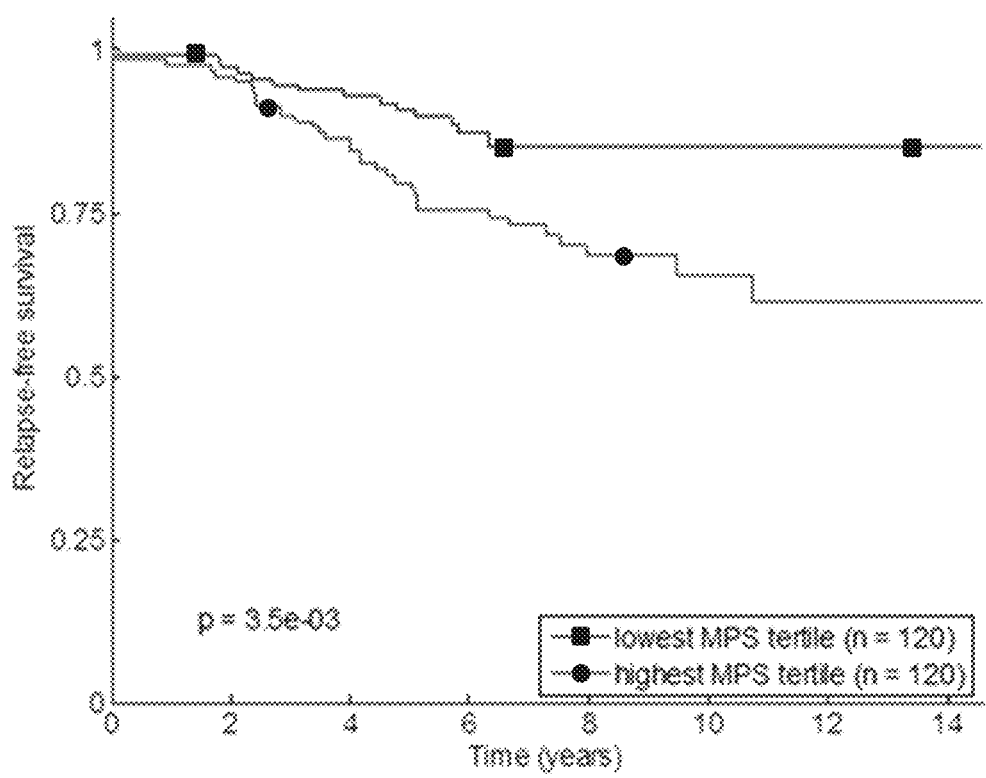
FIG. 28B shows a Kaplin-Meier plot of the distribution of pathway activity over breast cancer subtypes according to the intrinsic subtypes of the PAM50 algorithm; and the associated relapse-free survival according to the lowest (square) and highest (circle) tertiles of the MPS score within subtypes for the Luminal A subtype; the shown p-value is calculated using log-rank statistics.
Figure 28C:
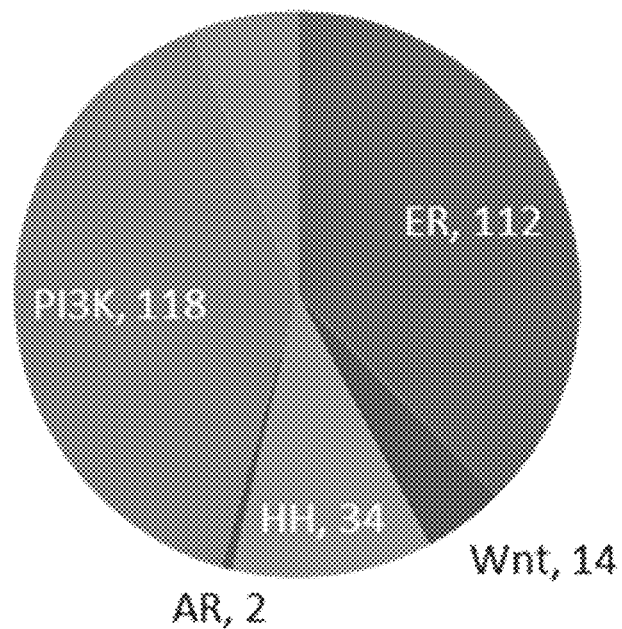
FIG. 28C shows the distribution of pathway activity over breast cancer subtypes according to the intrinsic subtypes of the PAM50 algorithm for the Luminal B subtype.
Figure 28D:
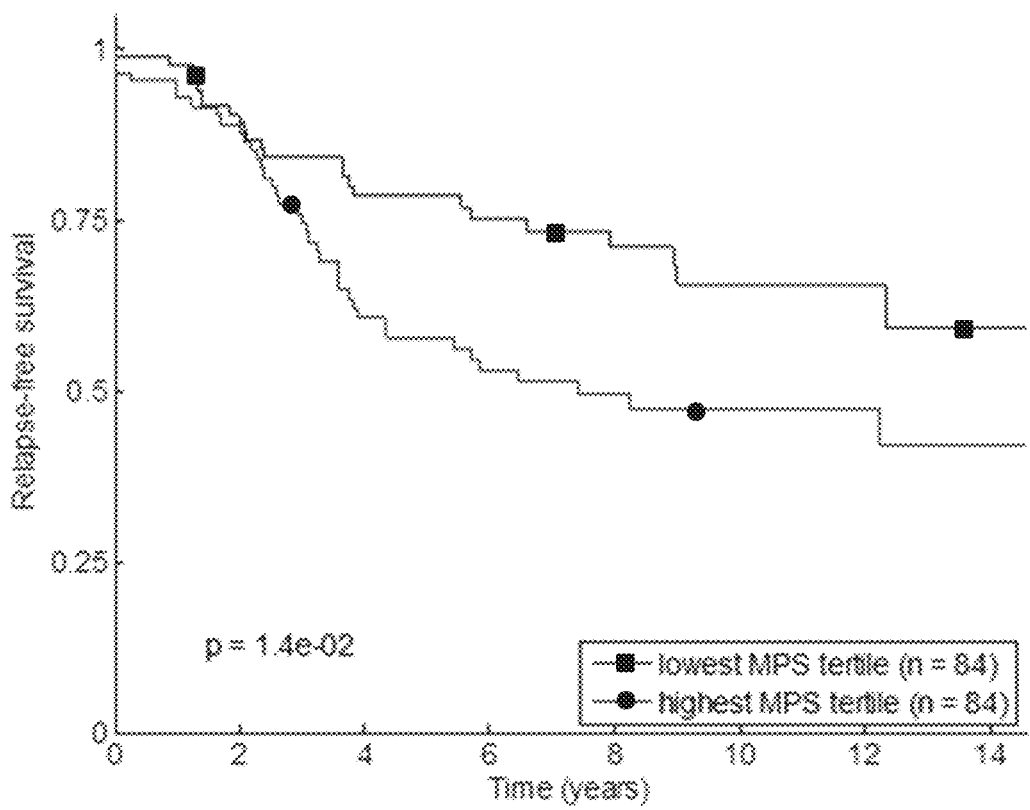
FIG. 28D shows a Kaplan-Meier plot of the distribution of pathway activity over breast cancer subtypes according to the intrinsic subtypes of the PAM50 algorithm; and the associated relapse-free survival according to the lowest (square) and highest (circle) tertiles of the MPS score within subtypes for the Luminal B subtype; the shown p-value is calculated using log-rank statistics.

Survival analyses demonstrate strong and largely independent prognostic power of the inferred activities of the ER, HH, PI3K and TGF-β pathways with respect to relapse-free survival in breast cancer patients, warranting a combination of these into one risk score (FIGS. 28B, D, F, H, and J). The Wnt pathway, which was borderline significant in the univariate analysis and not significant in the multivariate analysis due to only very few samples having an active Wnt pathway, was nevertheless selected to be included into the multi-pathway score based on the significant log-rank test results of Wnt active versus no pathways active (p=0.0011). The AR pathway was not informative with respect to prognosis and was therefore not included in the MPS for breast cancer. As discussed in the example 2, multi-pathway score (MPS) was derived using univariate Cox regression coefficients of the ER, Wnt, HH, PI3K and TGF-β pathways on 164 training samples of patients with ER positive breast cancer with known clinical outcome from the public datasets GSE6532 and GSE9195. Testing this MPS on the remaining 1005 patients with follow-up information resulted in a clear separation between high risk patients and low risk patients as can be seen in a Kaplan-Meier survival plot of the lowest and highest tertiles (p=8.6e-12, log-rank test, see FIG. 25B). MPS was highly associated with prognosis according to a univariate Cox regression analysis ($HR_{scaled}$=4.90, p=7.3e-15).

The 1294 breast cancer samples were divided into their intrinsic subtypes. The distribution of pathway activity across these subtypes is shown in FIGS. 28A, C, E, G and I. The ER pathway was found active most frequently in luminal A and B samples, which are generally the ER+ samples. Within the luminal samples, the ER pathway is active more often in the good-prognosis luminal A group than in the poor-prognosis luminal B group (FIGS. 28A and C), while the PI3K pathway is more frequently active in the luminal B samples.

Figure 28E:
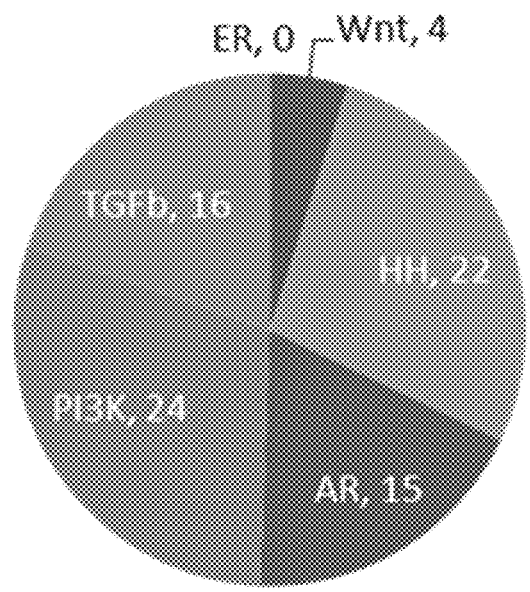
FIG. 28E shows the distribution of pathway activity over breast cancer subtypes according to the intrinsic subtypes of the PAM50 algorithm for the HER2 enriched subtype.
Figure 28F:
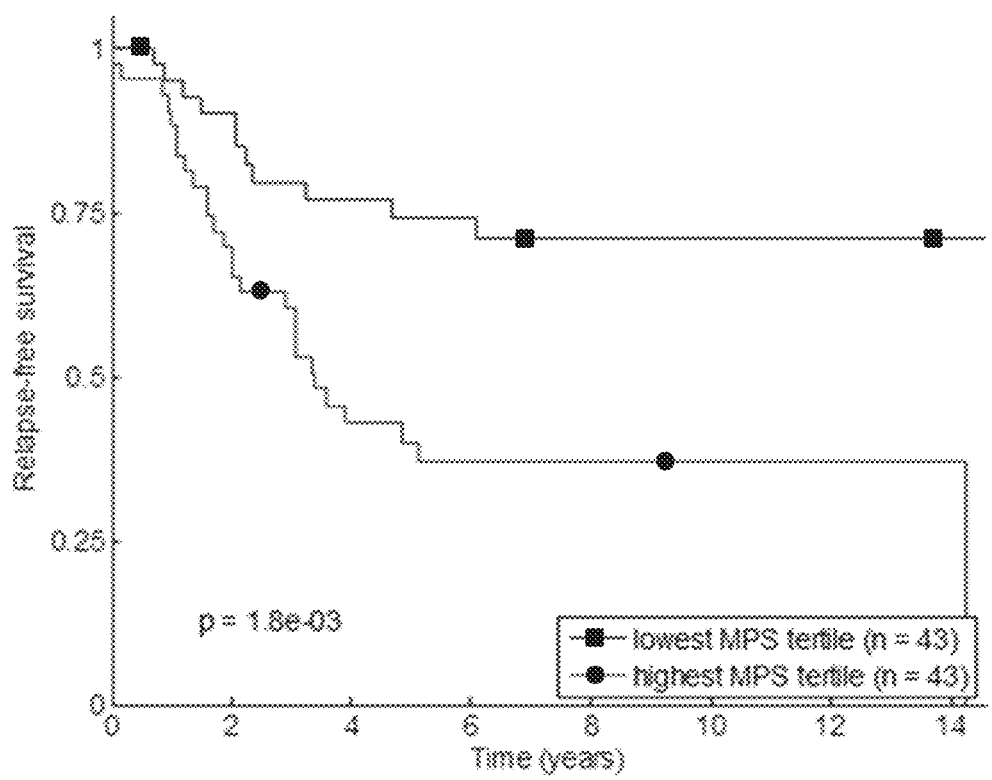
FIG. 28F shows a Kaplan-Meier plot of the distribution of pathway activity over breast cancer subtypes according to the intrinsic subtypes of the PAM50 algorithm; and the associated relapse-free survival according to the lowest (square) and highest (circle) tertiles of the MPS score within subtypes for the HER2 enriched subtype; the shown p-value is calculated using log-rank statistics.
Figure 28G:
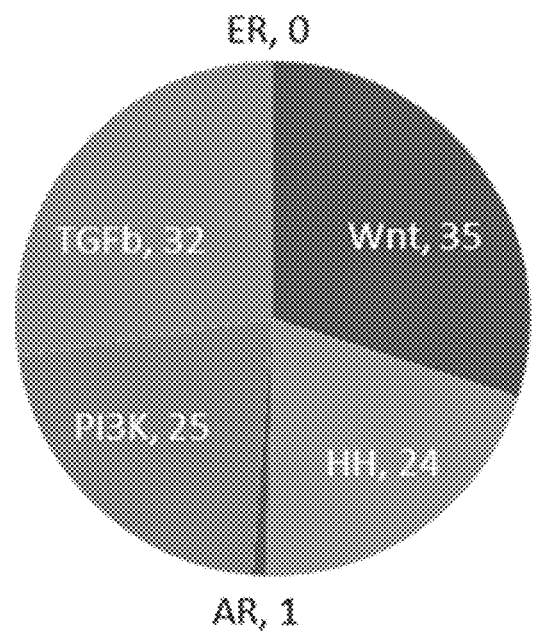
FIG. 28G shows the distribution of pathway activity over breast cancer subtypes according to the intrinsic subtypes of the PAM50 algorithm for the Basal subtype.

In contrast to the luminal samples, none of the HER2 enriched and basal type samples showed an active ER pathway, while in addition to the PI3K pathway, the embryonic pathways Wnt, HH and TGF-β appeared to be more frequently active in these cancer subtypes (FIGS. 28E and 28G), known to be more aggressive and associated with a worse prognosis. The Wnt pathway was a very prominent active pathway in the basal type (FIG. 28G). The largest fraction in the HER2 subtype has an active PI3K. In addition, the AR pathway showed up as active in quite a few HER2 cases.

Figure 28H:
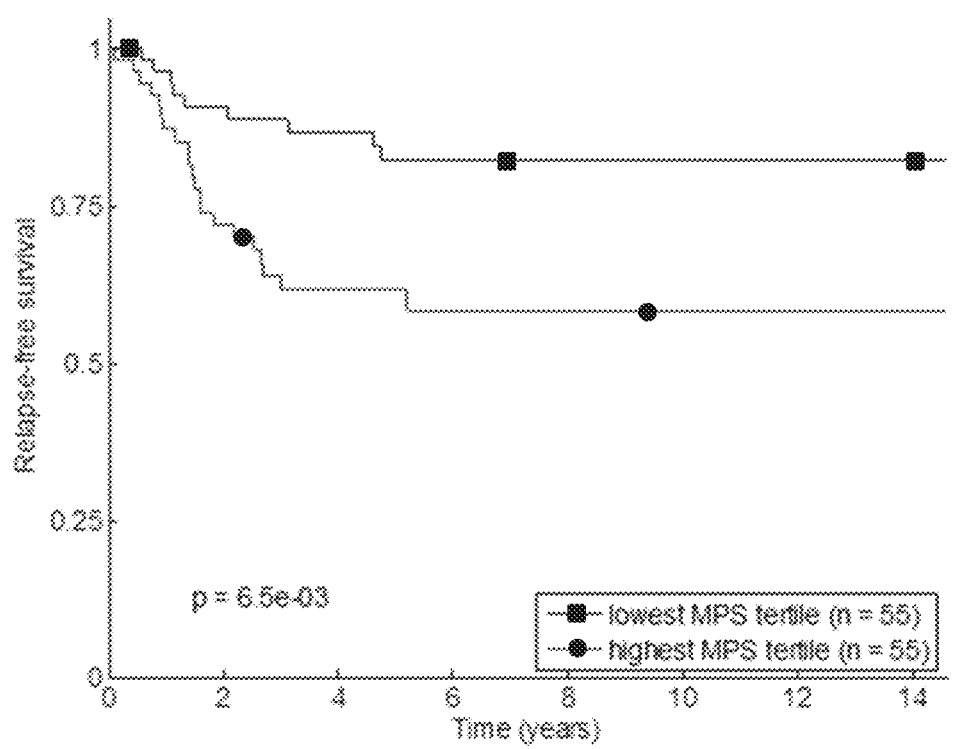
FIG. 28H shows a Kaplan-Meier plot of the distribution of pathway activity over breast cancer subtypes according to the intrinsic subtypes of the PAM50 algorithm; and the associated relapse-free survival according to the lowest (square) and highest (circle) tertiles of the MPS score within subtypes for the Basal subtype; the shown p-value is calculated using log-rank statistics.
Figure 28I:
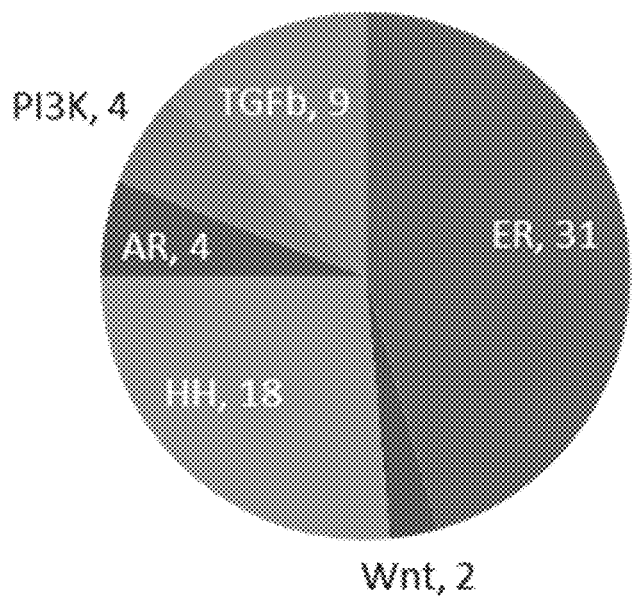
FIG. 28I shows the distribution of pathway activity over breast cancer subtypes according to the intrinsic subtypes of the PAM50 algorithm for the Normal-like subtype.

Normal-like breast cancer has been categorized as a specific subtype because, according to the PAM50 classification, it resembled gene expression in normal breast tissue. In the pathway analysis, the normal-like breast cancer samples could however be clearly distinguished from normal breast tissue and showed a high frequency of ER activity (FIG. 28I), while in normal breast tissue samples the ER pathway was not detected as active. Furthermore, the frequent activity of the HH pathway clearly differentiates this tumor subtype from normal breast tissue and the luminal subtype.

Figure 28J:
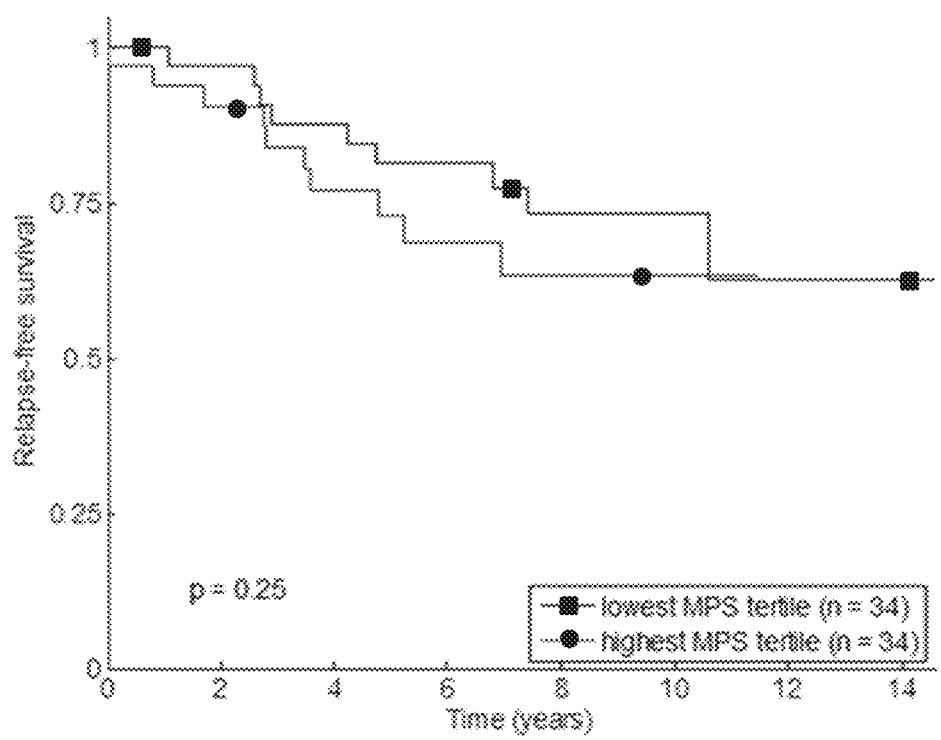
FIG. 28J shows a Kaplan-Meier plot of the distribution of pathway activity over breast cancer subtypes according to the intrinsic subtypes of the PAM50 algorithm; and the associated relapse-free survival according to the lowest (square) and highest (circle) tertiles of the MPS score within subtypes for the Normal-like subtype; the shown p-value is calculated using log-rank statistics.
Figure 29A:
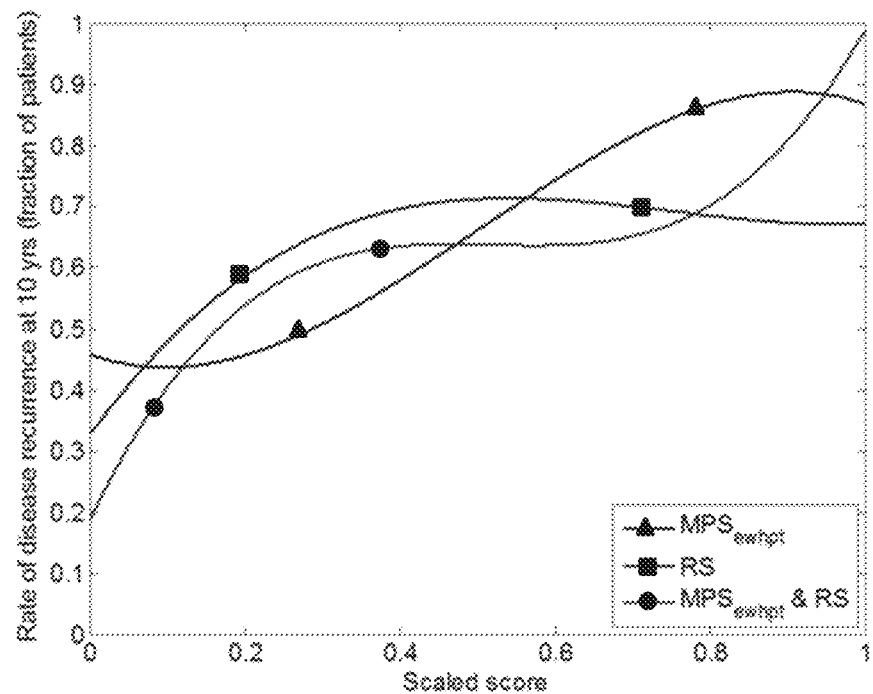
FIG. 29A shows the comparison of MPS with 21-gene recurrence score (RS). For the 1005 patients of the test set, the RS, MPS and combined score was calculated as described. Rate of disease recurrence as a function of MPS (triangle), 21-gene RS (square) and combined score (circle) within 5 years.
Figure 29B:
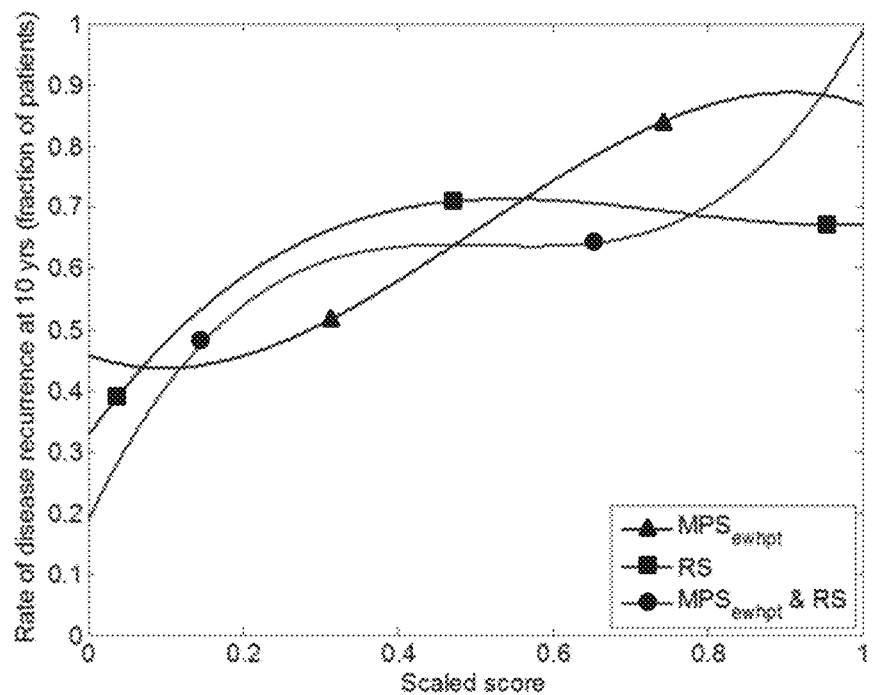
FIG. 29B shows the comparison of MPS with 21-gene recurrence score (RS). For the 1005 patients of the test set, the RS, MPS and combined score was calculated as described. Rate of disease recurrence as a function of MPS (triangle), 21-gene RS (square) and combined score (circle) within 10 years.
Figure 29C:
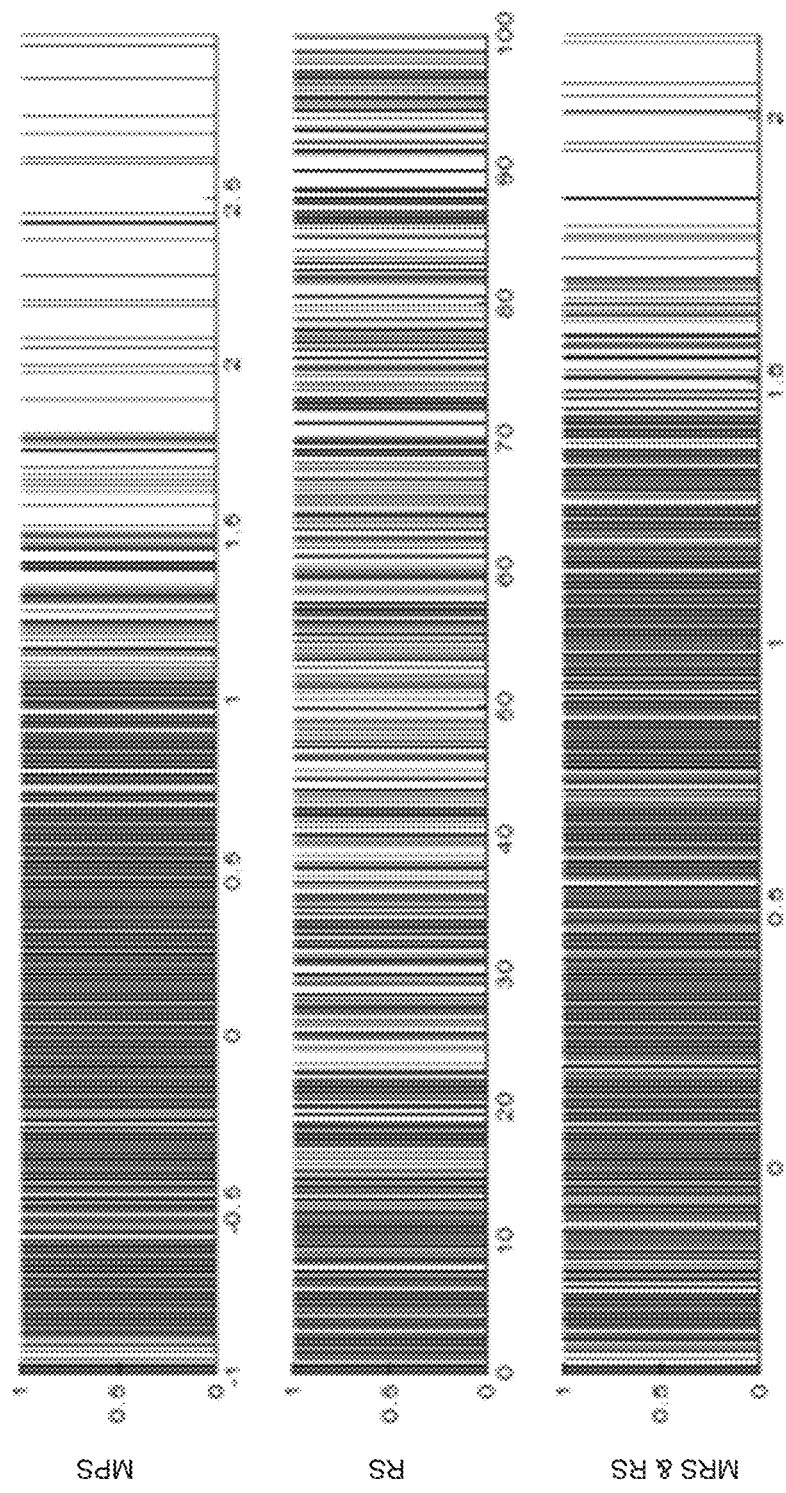
FIG. 29C shows the comparison of MPS with 21-gene recurrence score (RS). For the 1005 patients of the test set, the RS, MPS and combined score was calculated as described. The distributions of the MPS, 21-gene recurrence score (RS) and combined score corresponding to FIG. 29A are shown for 5 years.
Figure 29D:
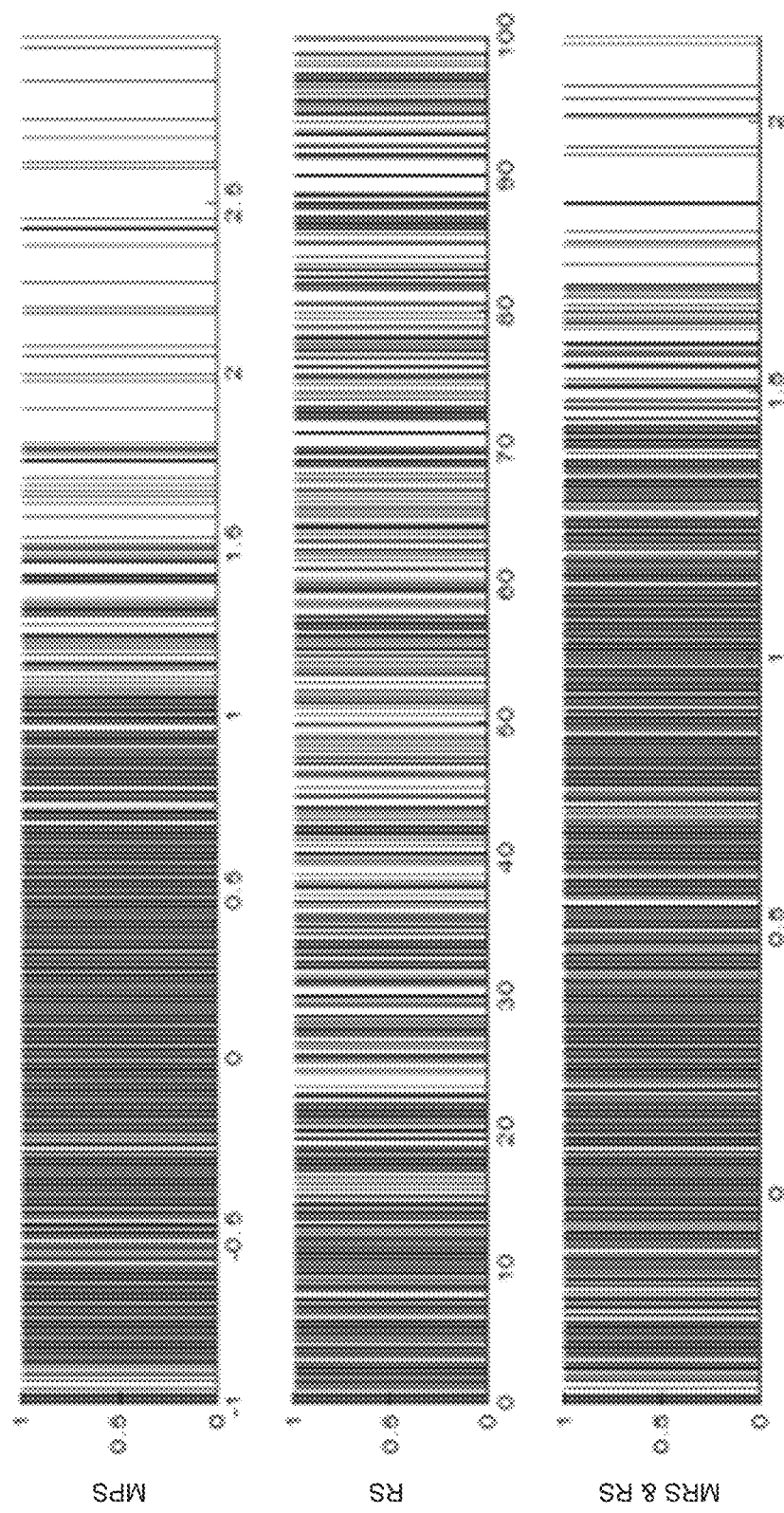
FIG. 29D shows the comparison of MPS with 21-gene recurrence score (RS). For the 1005 patients of the test set, the RS, MPS and combined score was calculated as described. The distributions of the MPS, 21-gene recurrence score (RS) and combined score corresponding to FIG. 29B are shown for 10 years.
Figure 29E:
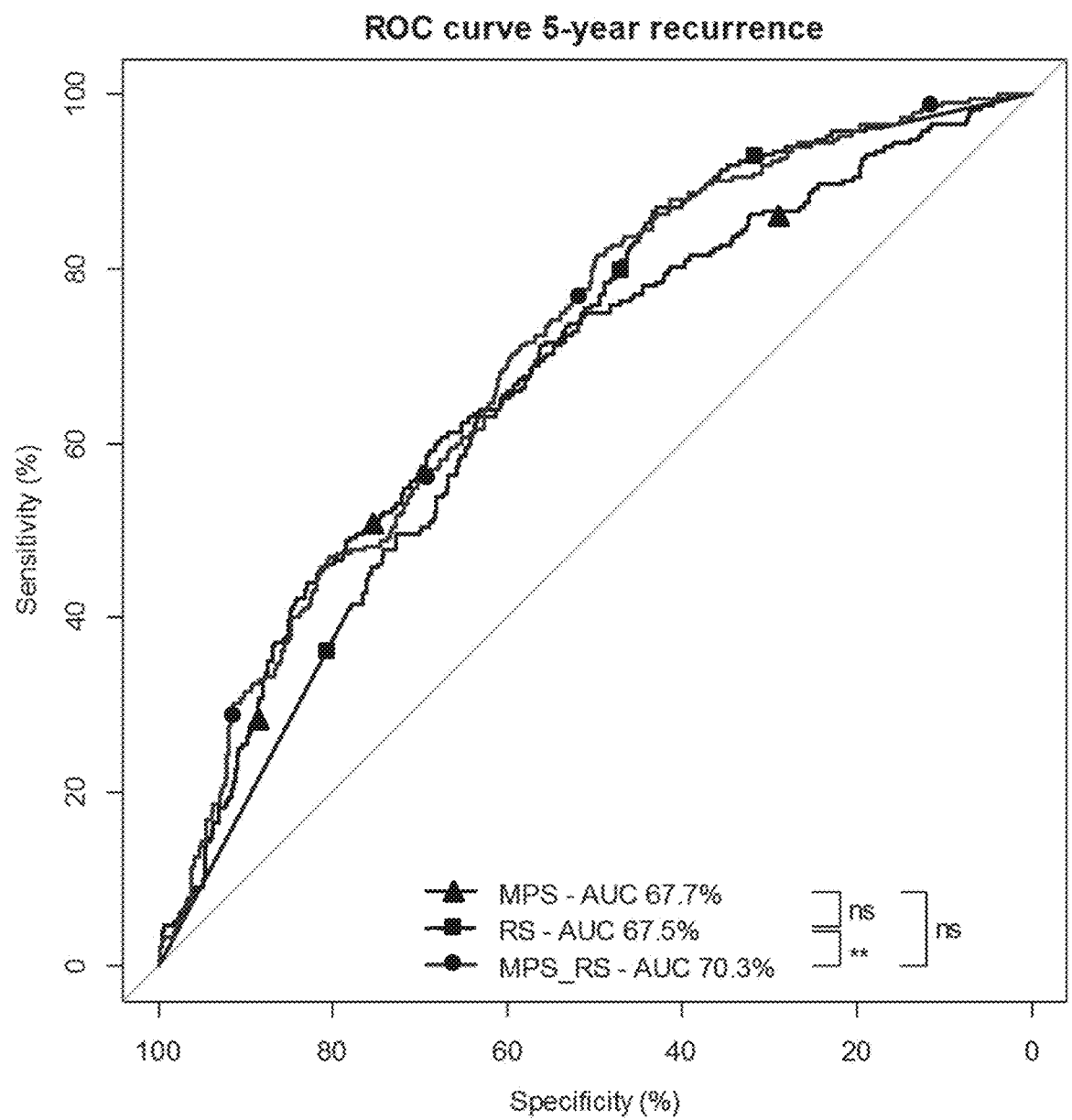
FIG. 29E shows the comparison of MPS with 21-gene recurrence score (RS). For the 1005 patients of the test set, the RS, MPS and combined score was calculated as described. The ROC curves for disease recurrence within 5 years (*: $p<0.05$, : $p<0.01$, **: $p<0.0001$) shows MPS and RS to be comparable, but the combined score of both functions is statistically more accurate.
Figure 29F:
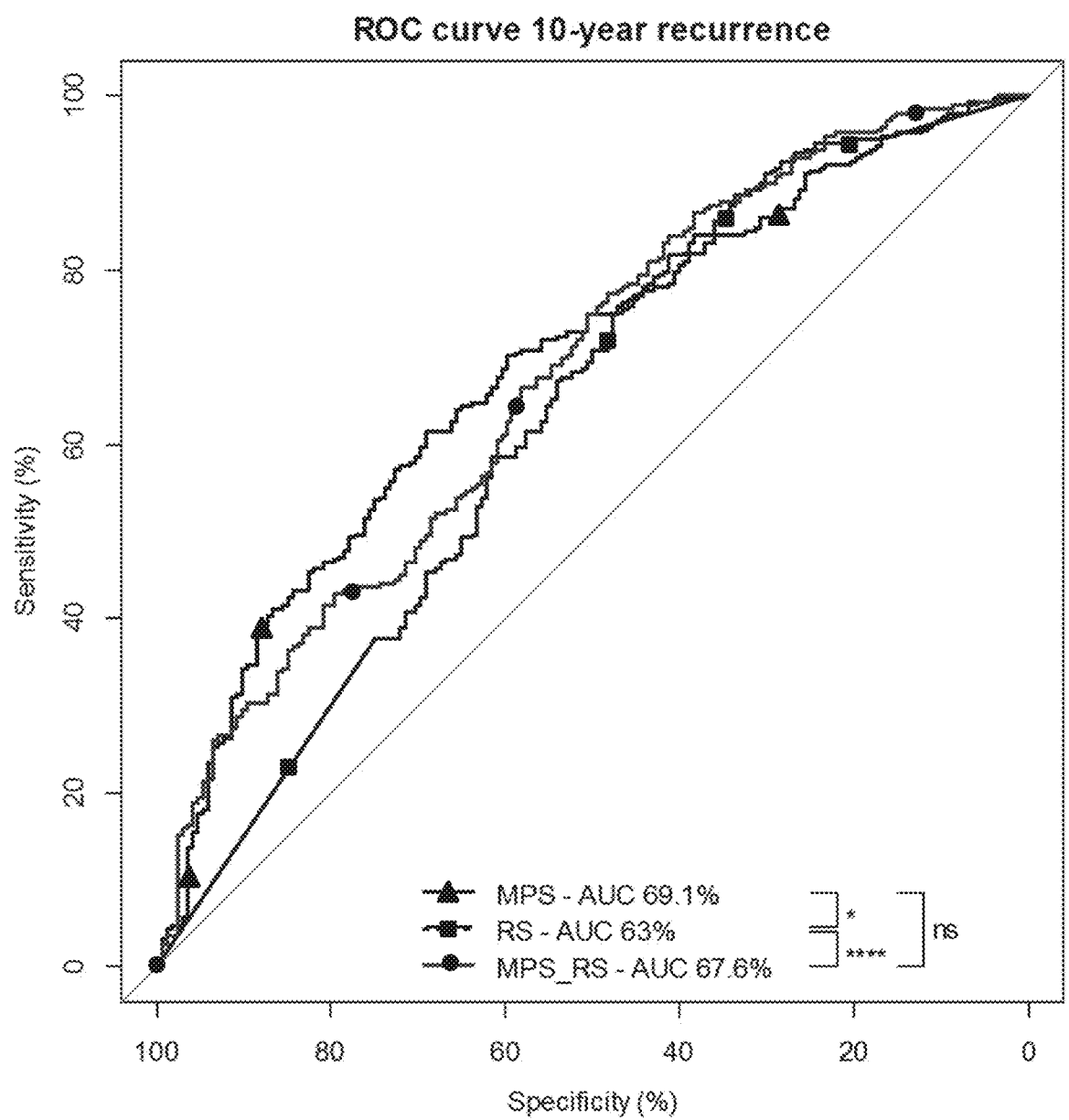
FIG. 29F shows the comparison of MPS with 21-gene recurrence score (RS). For the 1005 patients of the test set, the RS, MPS and combined score was calculated as described. The ROC curves for disease recurrence within 10 years (*: $p<0.05$, : $p<0.01$, **: $p<0.0001$) shows MPS to be statistically more accurate than RS.

Cox regression analysis was performed on the MPS and scaled within each subtype. Not only can the MPS test distinguish good from poor prognosis cases among luminal cancers ($HR_{scaled}$=4.11, p=2.1e-7), but also within the luminal A and B groups MPS can significantly stratify patients ($HR_{scaled}$=5.15 and 2.43, p=4.7e-5 and 1.3e-2, FIGS. 28B and D, respectively). Furthermore, MPS identified HER2 cases with a very poor prognosis ($HR_{scaled}$=4.81, p=3.2e-5, FIG. 28F) among the total group of HER2 enriched patients. Only 35% of the HER2 patients in the highest MPS tertile had a 5-year relapse-free survival. It should be noted though that these patients did not get any HER2 targeting drug. Within the basal population, which typically has a very bad prognosis compared to the other subtypes, MPS identifies a subgroup with a fairly good prognosis ($HR_{scaled}$=3.40, p=3.7e-3, FIG. 28H). Five year survival of patients with basal cancer falling in the lowest MPS tertile was 82% compared to 62% for the highest MPS tertile. Within the normal-like type breast cancers the MPS score was least prognostic ($HR_{scaled}$=3.53, p=0.05, FIG. 28J).

A multivariate analysis with the MPS and the 21-gene RS, (FIG. 29) shows that the two complement each other on the 1005 test samples ($HR_{scaled}$=3.32 and 1.92, p=1.5e-7 and 7.2e-5, respectively). When performed on the subset of 452 patients from the test cohort with a positive WIC staining for ER for which the 21-gene RS is clinically indicated, the MPS and 21-gene recurrence score both were still significant independent predictors of relapse-free survival (multivariate $HR_{scaled}$=2.25 and 2.75, p=0.025 and 4.5e-5, respectively), and thus the two are also complementary in ER positive samples.

The 21-gene recurrence score was calculated using a research implementation following the methodology as described earlier by Paik and co-workers (A multigene assay to predict recurrence of tamoxifen-treated, node-negative breast cancer. Paik S. Shak S, Tang G, Kim C, Baker J, Cronin M, Baehner F L, Walker M G, Watson D, Park T, Hiller W, Fisher E R, Wickerham D L, Bryant J, Wolmark N. 27, 2004, N Engl J Med, Vol. 351, pp. 2817-2826.) and its adaptation for microarray data by Fan and co-workers (Concordance among gene-expression-based predictors for breast cancer. Fan C, Oh D S, Wessels L, Weigelt B, Nuyten D S, Nobel A B, van't Veer L J, Perou C M. 6, 2006, N Engl J Med, Vol. 355, pp. 560-569.). fRMA-normalized expression of the probesets associated with the 21 genes was used as input for this research implementation of the 21-gene recurrence score. The average expression level was used in case a gene was measured by more than one probeset. The expression levels of the sixteen genes of interest were normalized relative to the average of the five reference genes and scaled as described by Fan et al. Next, the unsealed recurrence score (RSu) was computed for each sample using the equation and subsequently scaled between 0 and 100 as described earlier by Paik et al. Subsequently, each patient was assigned into low, intermediate or high risk groups using the published cutoff points at 18 and 31.

Univariate Cox analyses of the MPS for all 1005 test cases (FIG. 29) in the different risk groups of the 21-gene recurrence score demonstrated that the MPS is able to improve the prognosis in each risk group significantly (low, intermediate and high risk 21-gene RS giving for MPS an $HR_{scaled}$=3.03, 7.91 and 3.24, p=0.045, 0.044 and 9.5e-7, respectively), whereas the actual 21-gene recurrence score is only significant within its low risk group ($HR_{scaled}$=2.54, p=5.1e-3). The best of both prognostic profiles, that is identification of true low and high risk patients, was obtained by adding the scaled MPS and 21-gene RS ($HR_{scaled}$=5.17, p=7.9e-16, FIG. 29). The 21-gene RS is more powerful in detecting low risk patients, as can be seen in the disease recurrence rate plots and ROC curves (FIGS. 29A, B and 29E, F, respectively); in contrast, higher risk patients are identified more effectively by the MPS. The combined MPS and 21-gene RS retains the ability to identify low and high risk patients after merging the two scores, and overall shows best performance.

Taken together, this data demonstrates that the present disclosure can assess prognosis of individual breast cancer patients based on detection of functional activity of five major oncogenic signaling pathways in a cancer tissue sample. A combined multi-pathway score (MPS) clearly distinguishes good from poor prognosis cases, also within each breast cancer subtype, and this distinction is based on the influence of the individual signal transduction pathways on the causative cancer biology. The identified signal transduction pathway activities thus provide insight into the pathophysiology of breast cancer and provide clinically important information facilitating targeted therapy selection. The MPS achieved prognostic results comparable to the 21-gene recurrence score in ER positive patients, while providing better results in all other breast cancer subtypes, especially the HER2 and basal subtypes. Furthermore, the MPS can stratify according to risk within all defined risk groups of the 21-gene recurrence score, notably the stratification in the indecisive intermediate risk group of the 21-gene recurrence score, and can be used as a combined MPS—21-gene recurrence score test to achieve optimal performance for this specific test case.

Example 6: Sequence Listings Used in Application

| Sequence Listing: | |
| --- | --- |
| Seq. No. | Gene: |
| Seq. 1 | ADRA2C |
| Seq. 2 | AGRP |
| Seq. 3 | ANGPTL4 |
| Seq. 4 | AP1B1 |
| Seq. 5 | ASCL2 |
| Seq. 6 | ATG14 |
| Seq. 7 | ATP5J |
| Seq. 8 | ATP8A1 |
| Seq. 9 | AXIN2 |
| Seq. 10 | BCL2 |
| Seq. 11 | BCL2L11 |
| Seq. 12 | BCL6 |
| Seq. 13 | BIRC5 |
| Seq. 14 | BMP7 |
| Seq. 15 | BNIP3 |
| Seq. 16 | BTG1 |
| Seq. 17 | C10orf10 |
| Seq. 18 | CA12 |
| Seq. 19 | CAT |
| Seq. 20 | CAV1 |
| Seq. 21 | CBLB |
| Seq. 22 | CCND1 |
| Seq. 23 | CCND2 |
| Seq. 24 | CCNG2 |
| Seq. 25 | CD44 |
| Seq. 26 | CDC42EP3 |
| Seq. 27 | CDH26 |
| Seq. 28 | CDKN1A |

-continued

| Sequence Listing: | |
|---|---|
| Seq. No. | Gene: |
| Seq. 29 | CDKN1B |
| Seq. 30 | CDKN2B |
| Seq. 31 | CELSR2 |
| Seq. 32 | CFLAR |
| Seq. 33 | COL18A1 |
| Seq. 34 | COX7A2L |
| Seq. 35 | CTGF |
| Seq. 36 | CTSD |
| Seq. 37 | CTSL |
| Seq. 38 | DDB1 |
| Seq. 39 | DEFA6 |
| Seq. 40 | DKK1 |
| Seq. 41 | DSCAM |
| Seq. 42 | DYRK2 |
| Seq. 43 | EBAG9 |
| Seq. 44 | EPHB2 |
| Seq. 45 | EPHB3 |
| Seq. 46 | ERBB2 |
| Seq. 47 | ERBB3 |
| Seq. 48 | EREG |
| Seq. 49 | ESR1 |
| Seq. 50 | EXT1 |
| Seq. 51 | FASLG |
| Seq. 52 | FAT1 |
| Seq. 53 | FBXO32 |
| Seq. 54 | FGFR2 |
| Seq. 55 | FOXA2 |
| Seq. 56 | FOXF1 |
| Seq. 57 | FOXL1 |
| Seq. 58 | FOXM1 |
| Seq. 59 | FST |
| Seq. 60 | FYN |
| Seq. 61 | FZD7 |
| Seq. 62 | GADD45A |
| Seq. 63 | GADD45B |
| Seq. 64 | GLI1 |
| Seq. 65 | GLI3 |
| Seq. 66 | GLUL |
| Seq. 67 | GREB1 |
| Seq. 68 | H19 |
| Seq. 69 | HHIP |
| Seq. 70 | HMGA2 |
| Seq. 71 | HNF1A |
| Seq. 72 | HSPB1 |
| Seq. 73 | ID1 |
| Seq. 74 | IGF1R |
| Seq. 75 | IGFBP1 |
| Seq. 76 | IGFBP3 |
| Seq. 77 | IGFBP4 |
| Seq. 78 | IGFBP6 |
| Seq. 79 | IL11 |
| Seq. 80 | IL1R2 |
| Seq. 81 | IL8 (CXCL8) |
| Seq. 82 | INPP5D |
| Seq. 83 | INSR |
| Seq. 84 | JAG2 |
| Seq. 85 | JUNB |
| Seq. 86 | JUP |
| Seq. 87 | KIAA1199 (CEMIP) |
| Seq. 88 | KLF2 |
| Seq. 89 | KLF4 |
| Seq. 90 | KLF6 |
| Seq. 91 | KRT19 |
| Seq. 92 | LECT2 |
| Seq. 93 | LEF1 |
| Seq. 94 | LGMN |
| Seq. 95 | LGR5 |
| Seq. 96 | MIF |
| Seq. 97 | MMP2 |
| Seq. 98 | MMP9 |
| Seq. 99 | MXI1 |
| Seq. 100 | MYC |
| Seq. 101 | MYCN |
| Seq. 102 | MYLK |
| Seq. 103 | MYOD1 |

-continued

| Sequence Listing: | |
|---|---|
| Seq. No. | Gene: |
| Seq. 104 | NDUFV3 |
| Seq. 105 | NKD1 |
| Seq. 106 | NKX2-2 |
| Seq. 107 | NKX2-5 |
| Seq. 108 | NKX2-8 |
| Seq. 109 | NOS3 |
| Seq. 110 | NRIP1 |
| Seq. 111 | OAT |
| Seq. 112 | OVOL1 |
| Seq. 113 | PCK1 |
| Seq. 114 | PDGFB |
| Seq. 115 | PDK4 |
| Seq. 116 | PGR |
| Seq. 117 | PISD |
| Seq. 118 | PITRM1 |
| Seq. 119 | POMC |
| Seq. 120 | PPARG |
| Seq. 121 | PPARGC1A |
| Seq. 122 | PPM1D |
| Seq. 123 | PRDM15 |
| Seq. 124 | PRDX3 |
| Seq. 125 | PTCH1 |
| Seq. 126 | PTCH2 |
| Seq. 127 | PTHLH |
| Seq. 128 | PTMA |
| Seq. 129 | RAB34 |
| Seq. 130 | RAG1 |
| Seq. 131 | RAG2 |
| Seq. 132 | RARA |
| Seq. 133 | RBL2 |
| Seq. 134 | REG1B |
| Seq. 135 | RNF43 |
| Seq. 136 | S100A7 |
| Seq. 137 | S100A9 |
| Seq. 138 | SEMA3C |
| Seq. 139 | SEPP1 |
| Seq. 140 | SESN1 |
| Seq. 141 | SGK1 |
| Seq. 142 | SGK3 |
| Seq. 143 | SIRT1 |
| Seq. 144 | SKIL |
| Seq. 145 | SLC1A2 |
| Seq. 146 | SLC5A3 |
| Seq. 147 | SMAD4 |
| Seq. 148 | SMAD5 |
| Seq. 149 | SMAD6 |
| Seq. 150 | SMAD7 |
| Seq. 151 | SNAI1 |
| Seq. 152 | SNAI2 |
| Seq. 153 | SOD1 |
| Seq. 154 | SOD2 |
| Seq. 155 | SOX9 |
| Seq. 156 | SP5 |
| Seq. 157 | SPP1 |
| Seq. 158 | STK11 |
| Seq. 159 | TBX3 |
| Seq. 160 | TCEA2 |
| Seq. 161 | TCF7L2 |
| Seq. 162 | TDGF1 |
| Seq. 163 | TFF1 |
| Seq. 164 | TIMP1 |
| Seq. 165 | TLE4 |
| Seq. 166 | TNFSF10 |
| Seq. 167 | TOM1 |
| Seq. 168 | TRIM25 |
| Seq. 169 | TSC22D1 |
| Seq. 170 | TXNIP |
| Seq. 171 | VEGFA |
| Seq. 172 | WISP2 |
| Seq. 173 | XBP1 |
| Seq. 174 | ZNRF3 |
| Seq. 175 | SERPINE1 |
| Seq. 176 | PDZK1 |

TABLE 25

Oligo Sequences for TGF-β Target Genes

| Target Gene | Oligo Name | Sequence 5'-3' | SEQ ID NO. |
|---|---|---|---|
| SMAD7 | SMAD7_For1 | TGCCTTCCTCCGCTGAAAC | 177 |
| SMAD7 | SMAD7_Rev2 | ACCACGCACCAGTGTGAC | 178 |
| SMAD7 | SMAD7_probe1 | TCCCAACTTCTTCTGGAGCCTGGG | 179 |
| SKIL | SKIL_For1 | GAAATGAAGGAGAAGTTTAGCA | 180 |
| SKIL | SKIL_Rev1 | GCTTTATAACAGGATACCATGAC | 181 |
| SKIL | SKIL_Probe1 | ACAGATGCACCATCAGGAATGGAATTACA | 182 |
| CTGF | CTGF_For1 | GAAGCTGACCTGGAAGAGAA | 183 |
| CTGF | CTGF_Rev1 | CCACAGAATTTAGCTCGGTATG | 184 |
| CTGF | CTGF_Probe2 | CCTATCAAGTTTGAGCTTTCTGGCTG | 185 |
| CDKN1A | CDKN1A_For1 | GAGACTCTCAGGGTCGAAA | 186 |
| CDKN1A | CDKN1A_Rev2 | CTGTGGGCGGATTAGGGCT | 187 |
| CDKN1A | CDKN1A_Probe1 | ATTTCTACCACTCCAAACGCCGGC | 188 |
| ID1 | ID1_For2 | TGAGGGAGAACAAGACCGAT | 189 |
| ID1 | ID1_Rev1 | ACTAGTAGGTGTGCAGAGA | 190 |
| ID1 | ID1_Probe1 | CACTGCGCCCTTAACTGCATCCA | 191 |
| ANGPTL4 | ANGPTL4_For3 | GCGAATTCAGCATCTGCAAAG | 192 |
| ANGPTL4 | ANGPTL4_Rev4 | CTTTCTTCGGGCAGGCTT | 193 |
| ANGPTL4 | ANGPTL4_Probe2 | ACCACAAGCACCTAGACCATGAGGT | 194 |
| GADD45B | GADD45B_For1 | GTCGGCCAAGTTGATGAATG | 195 |
| GADD45B | GADD45B_Rev1 | GATGAGCGTGAAGTGGATTTG | 196 |
| GADD45B | GADD45B_probe1 | CCATTGACGAGGAGGAGGAGGAT | 197 |
| CDC42EP3 | CDC42EP3_For1 | TGTGGTCAAGACTGGATGATG | 198 |
| CDC42EP3 | CDC42EP3_Rev1 | CAGAAGTGGCTTCGAAATGA | 199 |
| CDC42EP3 | CDC42EP3_Probe1 | TCTCTAGGAAGCCTCACTTGGCCG | 200 |
| JUNB | JUNB_For2 | AATGGAACAGCCCTTCTACCA | 201 |
| JUNB | JUNB_Rev1 | GCTCGGTTTCAGGAGTTTGTA | 202 |
| JUNB | JUNB_Probe1 | TCATACACAGCTACGGGATACGG | 203 |
| SNAI2 | SNAI2_For1 | GTTGCTTCAAGGACACATTAG | 204 |
| SNAI2 | SNAI2_Rev1 | GCAGATGAGCCCTCAGATTT | 205 |
| SNAI2 | SNAI2_Probe1 | TGCCCTCACTGCAACAGAGCATTT | 206 |
| VEGFA | VEGFA_For1 | GAAGGAGGAGGGCAGAATC | 207 |
| VEGFA | VEGFA_Rev1 | GTCTCGATTGGATGGCAGTA | 208 |
| VEGFA | VEGFA_Probe1 | AGTTCATGGATGTCTATCAGCGCAGC | 209 |
| SERPINE1 | SERPINE1_For1 | CCACAAATCAGACGGCAGCA | 210 |
| SERPINE1 | SERPINE1_Rev1 | GTCGTAGTAATGGCCATCGG | 211 |
| SERPINE1 | SERPINE1_Probe1 | CCCATGATGGCTCAGACCAACAAGT | 212 |

TABLE 26

Oligo Sequences for PI3K Target Genes

| Target Gene | Oligo Name | Sequence 5'-3' | SEQ ID NO. |
|---|---|---|---|
| FBXO31 | FBXO32_F1 | GCTGCTGTGGAAGAAACT | 213 |
| FBXO31 | FBXO32_R1 | GCCCTTTGTCTGACAGAATTA | 214 |
| FBXO31 | FBXO32_FAM1 | TGCCAGTACCACTTCTCCGAGC | 215 |
| BCL2L11 | BCL2L11_F1 | CCTTTCTTGGCCCTTGTT | 216 |
| BCL2L11 | BCL2L11_R1 | AAGGTTGCTTTGCCATTTG | 217 |
| BCL2L11 | BCL2L11_FAM1 | TGACTCTCGGACTGAGAAACGCAA | 218 |
| SOD2 | SOD2_F3 | AGCGGCTTCAGCAGATC | 219 |
| SOD2 | SOD2_R1 | GCCTGGAGCCCAGATAC | 220 |
| SOD2 | SOD2_FAM1 | ACTAGCAGCATGTTGAGCCGGG | 221 |
| TNFSF10 | TNFSF10_F1 | CCTGCAGTCTCTCTGTGT | 222 |
| TNFSF10 | TNFSF10_R2 | GCCACTTTTGGAGTACTTGT | 223 |
| TNFSF10 | TNFSF10_FAM1 | TACCAACGAGCTGAAGCAGATGCA | 224 |
| BCL6 | BCL6_F1 | GAGCCGTGAGCAGTTTAG | 225 |
| BCL6 | BCL6_R1 | GATCACACTAAGGTTGCATTTC | 226 |
| BCL6 | BCL6_FAM1 | AAACGGTCCTCATGGCCTGCA | 227 |
| BTG1 | BTG1_F1 | AAGTTTCTCCGCACCAAG | 228 |
| BTG1 | BTG1_R1 | CTGGGAACCAGTGATGTTTAT | 229 |
| BTG1 | BTG1_FAM1 | AGCGACAGCTGCAGACCTTCA | 230 |
| CCNG2 | CCNG2_F1 | ACAGGTTCTTGGCTCTTATG | 231 |
| CCNG2 | CCNG2_R1 | TGCAGTCTTCTTCAACTATTCT | 232 |
| CCNG2 | CCNG2_FAM1 | ACATTTGTCTTGCATTGGAGTCTGT | 233 |
| CDKN1B | CDKN1B_F2 | CGGTTCTGTGGAGCAGACG | 234 |
| CDKN1B | CDKN1B_R1 | CTTCATCAAGCAGTGATGTATCTG | 235 |
| CDKN1B | CDKN1B_P2 | CCTGGCCTCAGAAGACGTCAAAC | 236 |
| BNIP3 | BNIP3_F4 | GATATGGGATTGGTCAAGTCG | 237 |
| BNIP3 | BNIP3_R2 | CGCTCGTGTTCCTCATGCTG | 238 |
| BNIP3 | BNIP3_FAM1 | TTAAACACCCGAAGCGCACGGC | 239 |
| GADD45A | GADD45A_F1 | CAGAAGACCGAAAGGATGGA | 240 |
| GADD45A | GADD45A_R1 | GGCACAACACCACGTTATC | 241 |
| GADD45A | GADD45A_FAM1 | ACGAAGCGGCCAAGCTGCTCAA | 242 |
| INSR | INSR_F2 | CTCGGTCATGAAGGGCTTCA | 243 |
| INSR | INSR_R2 | CCGCAGAGAACGGAGGTAG | 244 |
| INSR | INSR_P2 | ACGCTGGTGGTGATGGAGCTGA | 245 |
| MXI1 | MXI1_F2 | CTGATTCCACTAGGACCAGAC | 246 |
| MXI1 | MXI1_R2 | CTCTGTTCTCGTTCCAAATTCTC | 247 |
| MXI1 | MXI1_P2 | CCCGGCACAACACTTGGTTTGC | 248 |

TABLE 27

Oligo Sequences for Wnt Target Genes

| Target Gene | Oligo Name | Sequence 5'-3' | SEQ ID NO. |
|---|---|---|---|
| AXIN2 | AXIN2_For1 | GACAGTGAGATATCCAGTGATG | 249 |
| AXIN2 | AXIN2_Rev1 | CTTACTGCCCACACGATAAG | 250 |
| AXIN2 | AXIN2_Probe1 | CATGACGGACAGCAGTGTAGATGGA | 251 |
| CD44 | CD44_For1 | CAATGCCTTTGATGGACCAATTA | 252 |
| CD44 | CD44_Rev1 | GGGTAGATGTCTTCAGGATTCG | 253 |
| CD44 | CD44_Probe1 | TGATGGCACCCGCTATGTCCAGAA | 254 |
| LGR5 | LGR5_For1 | ACTTTCCAGCAGTTGCTTAG | 255 |
| LGR5 | LGR5_Rev2 | GGCAAAGTGGAAAATGCATTG | 256 |
| LGR5 | LGR5_Probe1 | TCCGATCGCTGAATTTGGCTTGA | 257 |
| CEMIP (KIAA1199) | CEMIP_For6 | ACATTCCACTGGGAAAATTCTA | 258 |
| CEMIP (KIAA1199) | CEMIP_Rev5 | GCTTGTCCTTGGCAGAG | 259 |
| CEMIP (KIAA1199) | CEMIP_Probe3 | TACCGGGCTGGCATGATCATAGACA | 260 |
| MYC | MYC_For1 | TTCGGGTAGTGGAAAACCA | 261 |
| MYC | MYC_Rev1 | CATAGTTCCTGTTGGTGAAGC | 262 |
| MYC | MYC_Probe1 | CTCCCGCGACGATGCCCCTCAA | 263 |
| CXCL8 (IL8) | CXCL8_For1 | GGCAGCCTTCCTGATTTCTG | 264 |
| CXCL8 (IL8) | CXCL8_Rev1 | GGTGGAAAGGTTTGGAGTATG | 265 |
| CXCL8 (IL8) | CXCL8_Probe1 | CAGCTCTGTGTGAAGGTGCAGTTT | 266 |
| SOX9 | SOX9_For5 | GACCAGTACCCGCACTT | 267 |
| SOX9 | SOX9_Rev6 | CGCTTCTCGCTCTCGTT | 268 |
| SOX9 | SOX9_P3 | CGCTGGGCAAGCTCTGGAGACT | 269 |
| EPHB3 | EPHB3_For1 | TCACTGAGTTCATGGAAAACTG | 270 |
| EPHB3 | EPHB3_Rev1 | GTTCATCTCGGACAGGTACTT | 271 |
| EPHB3 | EPHB3_Probe1 | CCTTCCTCCGGCTCAACGATGGG | 272 |
| RNF43 | RNF43_For1 | GTTACATCAGCATCGGACTTG | 273 |
| RNF43 | RNF43_Rev1 | GAGTCTTCGACCTGGTTCTT | 274 |
| RNF43 | RNF43_Probe1 | AGTCCCTGGGACCCTCTGATCTTA | 275 |
| TDGF1 | TDGF1_For6 | TCCGCTGCTTTCCTCAG | 276 |
| TDGF1 | TDGF1_Rev6 | GCAGATGCCAACTAGCATAAA | 277 |
| TDGF1 | TDGF1_Probe1 | TACCCGGCTGTGATGGCCTTGTG | 278 |

TABLE 27-continued

Oligo Sequences for Wnt Target Genes

| Target Gene | Oligo Name | Sequence 5'-3' | SEQ ID NO. |
|---|---|---|---|
| ZNRF3 | ZNRF3_For2 | AAGCTGGAACAGCCAGAATT | 279 |
| ZNRF3 | ZNRF3_Rev1 | CATCAAAGATGACTGCAGTAGCT | 280 |
| ZNRF3 | ZNRF3_Probe1 | TCCTAGGCAAGGCCAAGCGAGC | 281 |
| DEFA6 | DEFA6_For3 | AGAGGATGCAAGCTCAAGT | 282 |
| DEFA6 | DEFA6_Rev1 | AATAACAGGACCTTCTGCAATG | 283 |
| DEFA6 | DEFA6_Probe1 | TGGGCTCAACAAGGGCTTTCACTT | 284 |

TABLE 28

Oligo Sequences for ER Target Genes

| Target Gene | Oligo Name | Sequence 5'-3' | SEQ ID NO. |
|---|---|---|---|
| TFF1 | TFF1_F4 | CCCTGGTGCTTCTATCCTAA | 285 |
| TFF1 | TFF1_R4 | ATCCCTGCAGAAGTGTCTAA | 286 |
| TFF1 | TFF1_P4 | ACCATCGACGTCCCTCCAGAA | 287 |
| GREB1 | GREB1_F9 | AAGAGGTTCTTGCCAGATGA | 288 |
| GREB1 | GREB1_R10 | GGAGAATTCCGTGAAGTAACAG | 289 |
| GREB1 | GREB1_P8 | TCTCTGGGAATTGTGTTGGCTGTGGA | 290 |
| PGR | PGR_F3 | TGGCAGATCCCACAGGAGTT | 291 |
| PGR | PGR_R7 | AGCCCTTCCAAAGGAATTGTATTA | 292 |
| PGR | PGR_P7 | AGCTTCAAGTTAGCCAAGAAGAGTTCCTCT | 293 |
| SGK3 | SGK3_F1 | CTGCCAAGAGAATATTTGGTGATAA | 294 |
| SGK3 | SGK3_R1 | TGGATACCTAACTAGGTTCTGAATG | 295 |
| SGK3 | SGK3_P1 | ACAAAGACGAGCAGGACTAAACGA | 296 |
| PDZK1 | PDZK1_F4 | GCCATGAGGAAGTGGTTGAAA | 297 |
| PDZK1 | PDZK1_R4 | TGCTCAACATGACGCTTGTC | 298 |
| PDZK1 | PDZK1_P1 | AAGCCGTGTCATGTTCCTGCTGGT | 299 |
| IGFBP4 | IGFBP4_F4 | CCAACTGCGACCGCAAC | 300 |
| IGFBP4 | IGFBP4_R3 | GTCTTCCGGTCCACACAC | 301 |
| IGFBP4 | IGFBP4_P3 | CAAGCAGTGTCACCCAGCTCTGGA | 302 |
| NRIP1 | NRIP1_F3 | CCGGATGACATCAGAGCTA | 303 |
| NRIP1 | NRIP1_R3 | AATGCAAATATCAGTGTTCGTC | 304 |
| NRIP1 | NRIP1_P2 | TCTCAGAAAGCAGAGGCTCAGAGCTT | 305 |
| CA12 | CA12_F4 | GGCATTCTTGGCATCTGTATT | 306 |
| CA12 | CA12_R4 | GCTTGTAAATGACTCCCTTGTT | 307 |
| CA12 | CA12_P2 | TGGTGGTGGTGTCCATTTGGCTTT | 308 |
| XBP1 | XBP1_F1 | GGATTCTGGCGGTATTGACT | 309 |
| XBP1 | XBP1_R3 | CATGACTGGGTCCAAGTTGTC | 310 |
| XBP1 | XBP1_P4 | TCAGAGTCTGATATCCTGTTGGGCATTCTG | 311 |
| ERBB2 | ERBB2_F1 | GTTTGAGTCCATGCCCAATC | 312 |
| ERBB2 | ERBB2_R2 | GATCCCACGTCCGTAGAAA | 313 |

TABLE 28-continued

Oligo Sequences for ER Target Genes

| Target Gene | Oligo Name | Sequence 5'-3' | SEQ ID NO. |
|---|---|---|---|
| ERBB2 | ERBB2_P1 | CGCCAGCTGTGTGACTGCCTGT | 314 |
| ESR1 | ESR1_F1 | AGCTTCGATGATGGGCTTAC | 315 |
| ESR1 | ESR1_R2 | CCTGATCATGGAGGGTCAAA | 316 |
| ESR1 | ESR1_P1 | CAACTGGGCGAAGAGGGTGCCA | 317 |
| CELSR2 | CELSR2_F2 | GGTCCGGAAAGCACTCAA | 318 |
| CELSR2 | CELSR2_R2 | TCCGTAGGGCTGGTACA | 319 |
| CELSR2 | CELSR2_P2 | TCCTACAACTGCCCCAGCCCTA | 320 |

TABLE 29

Oligo Sequences for HH Target Genes

| Target Gene | Oligo Name | Sequence 5'-3' | SEQ ID NO. |
|---|---|---|---|
| GLI1 | GLI1_F6 | CAGTACATGCTGGTGGTTCAC | 321 |
| GLI1 | GLI1_R6 | TTCGAGGCGTGAGTATGACTT | 322 |
| GLI1 | GLI1_P6 | ACTGGCGAGAAGCCACACAAGTGC | 323 |
| PTCH1 | PTCH1_F10 | CTTCTTCATGGCCGCGTTAAT | 324 |
| PTCH1 | PTCH1_R10 | AATGAGCAGAACCATGGCAAA | 325 |
| PTCH1 | PTCH1_P9 | TCCAGGCAGCGGTAGTAGTGGTGT | 326 |
| PTCH2 | PTCH2_F13 | CTCCACTGCCCACCTAGT | 327 |
| PTCH2 | PTCH2_R11 | CTCCTGCCAGTGCATGAATTT | 328 |
| PTCH2 | PTCH2_P11 | ATCACAGCAGGCAGGCTCCCAATG | 329 |
| CCND2 | CCND2_F2 | ACACCGACAACTCCATCAA | 330 |
| CCND2 | CCND2_R2 | CGCAAGATGTGCTCAATGAA | 331 |
| CCND2 | CCND2_P2 | TGGAGTGGGAACTGGTGGTGCT | 332 |
| IGFBP6 | IGFBP6_F5 | CCCTCCCAGCCCAATTC | 333 |
| IGFBP6 | IGFBP6_R5 | GGGCACGTAGAGTGTTTGA | 334 |
| IGFBP6 | IGFBP6_P2 | TGCCGTAGACATCTGGACTCAGTGCT | 335 |
| MYCN | MyeN_F2 | GACACCCTGAGCGATTC | 336 |
| MYCN | MyeN_R4 | GAATGTGGTGACAGCCTTG | 337 |
| MYCN | MyeN_P3 | TGAAGATGATGAAGAGGAAGATGAAGAGG | 338 |
| FST | FST_F1 | AGCCTATGAGGGAAAGTGTATC | 339 |
| FST | FST_R2 | CCCAACCTTGAAATCCCATAAA | 340 |
| FST | FST_P1 | AGCAAAGTCCTGTGAAGATATCCAGTGCAC | 341 |
| RAB34 | RAB34_F3 | GGGCAGGAGAGGTTCAAATG | 342 |
| RAB34 | RAB34_R3 | CAGCCACTGCTTGGTATGTT | 343 |
| RAB34 | RAB34_P3 | TCTTCAACCTGAATGATGTGGCATCTCTGG | 344 |
| GLI3 | GLI3_F1 | CCTGTACCAATTGATGCCAGAC | 345 |

TABLE 29-continued

Oligo Sequences for HH Target Genes

| Target Gene | Oligo Name | Sequence 5'-3' | SEQ ID NO. |
|---|---|---|---|
| GLI3 | GLI3_R2 | CGGATACGTAGGGCTACTAGATAAG | 346 |
| GLI3 | GLI3_P2 | ACGATCCATCTCCGATTCCTCCATTGCA | 347 |
| CFLAR | CFLAR_F3 | GGTGAGGATTTGGATAAATCTGATG | 348 |
| CFLAR | CFLAR_R1 | TCAACCACAAGGTCCAAGAAAC | 349 |
| CFLAR | CFLAR_P2 | ACATGGGCCGAGGCAAGATAAGCAA | 350 |
| S100A7 | S100A7_F1 | CCAGACGTGATGACAAGATTGAG | 351 |
| S100A7 | S100A7_R1 | GCGAGGTAATTTGTGCCCTT | 352 |
| S100A7 | S100A7_P1 | CCCAACTTCCTTAGTGCCTGTGACA | 353 |
| S100A9 | S100A9_F1 | ATTCAAAGAGCTGGTGCGAAA | 354 |
| S100A9 | S100A9_R2 | AGGTCCTCCATGATGTGTTCT | 355 |
| S100A9 | S100A9_P2 | CTGCAAAATTTCTCAAGAAGGAGAATAAGAATG | 356 |

TABLE 30

Oligo Sequences for Reference Genes

| Reference Gene | Oligo Name | Sequence 5'-3' | SEQ ID NO. |
|---|---|---|---|
| ACTB | Hum_BACT_F1 | CCAACCGCGAGAAGATGA | 357 |
| ACTB | Hum_BACT_R1 | CCAGAGGCGTACAGGGATAG | 358 |
| ACTB | Hum_BACT_P1 | CCATGTACGTTGCTATCCAGGCT | 359 |
| POLR2A | Hum_POLR2A_F1 | AGTCCTGAGTCCGGATGAA | 360 |
| POLR2A | Hum_POLR2A_R1 | CCTCCCTCAGTCGTCTCT | 361 |
| POLR2A | Hum_POLR2A_P1 | TGACGGAGGGTGGCATCAAATACC | 362 |
| PUM1 | Hum_PUM1_F2 | GCCAGCTTGTCTTCAATGAAAT | 363 |
| PUM1 | Hum_PUM1_R2 | CAAAGCCAGCTTCTGTTCAAG | 364 |
| PUM1 | Hum_PUM1_P1 | ATCCACCATGAGTTGGTAGGCAGC | 365 |
| TBP | Hum_TBP_F1 | GCCAAGAAGAAAGTGAACATCAT | 366 |
| TBP | Hum_TBP1_R1 | ATAGGGATTCCGGGAGTCAT | 367 |
| TBP | Hum_TBP_P1 | TCAGAACAACAGCCTGCCACCTTA | 368 |
| TUBA1B | K-ALPHA-1_F1 | TGACTCCTTCAACACCTTCTTC | 369 |
| TUBA1B | K-ALPHA-1_R1 | TGCCAGTGCGAACTTCAT | 370 |
| TUBA1B | K-ALPHA-1_FAM1 | CCGGGCTGTGTTTGTAGACTTGGA | 371 |
| ALAS1 | ALAS1_F1 | AGCCACATCATCCCTGT | 372 |
| ALAS1 | ALAS1_R1 | CGTAGATGTTATGTCTGCTCAT | 373 |
| ALAS1 | ALAS1_FAM1 | TTTAGCAGCATCTGCAACCCGC | 374 |
| HPRT1 | Hum_HPRT1_F1 | GAGGATTTGGAAAGGGTGTTTATT | 375 |
| HPRT1 | Hum_HPRT1_R1 | ACAGAGGGCTACAATGTGATG | 376 |
| HPRT1 | Hum_HPRT1_P1 | ACGTCTTGCTCGAGATGTGATGAAGG | 377 |
| RPLP0 | Hum_RPLP0_F2 | TAAACCCTGCGTGGCAAT | 378 |

TABLE 30-continued

Oligo Sequences for Reference Genes

| Reference Gene | Oligo Name | Sequence 5'-3' | SEQ ID NO. |
|---|---|---|---|
| RPLP0 | Hum_RPLP0_R2 | ACATTTCGGATAATCATCCAATAGTTG | 379 |
| RPLP0 | Hum_RPLP0_P1 | AAGTAGTTGGACTTCCAGGTCGCC | 380 |
| B2M | Hum_B2M_F1 | CCGTGGCCTTAGCTGTG | 381 |
| B2M | Hum_B2M_R1 | CTGCTGGATGACGTGAGTAAA | 382 |
| B2M | Hum_B2M_P1 | TCTCTCTTTCTGGCCTGGAGGCTA | 383 |
| TPT1 | TPT1_F_PACE | AAATGTTAACAAATGTGGCAATTAT | 384 |
| TPT1 | TPT1_R_PACE | AACAATGCCTCCACTCCAAA | 385 |
| TPT1 | TPT1_P_PACE | TCCACACAACACCAGGACTT | 386 |
| EEF1A1 | EEF1A1_F_PACE | TGAAAACTACCCCTAAAAGCCA | 387 |
| EEF1A1 | EEF1A1_R_PACE | TATCCAAGACCCAGGCATACT | 388 |
| EEF1A1 | EEF1A1_P_PACE | TAGATTCGGGCAAGTCCACCA | 389 |
| RPL41 | RPL41_F_PACE | AAGATGAGGCAGAGGTCCAA | 390 |
| RPL41 | RPL41_R_PACE | TCCAGAATGTCACAGGTCCA | 391 |
| RPL41 | RPL41_P_PACE | TGCTGGTACAAGTTGTGGGA | 392 |

This specification has been described with reference to embodiments, which are illustrated by the accompanying Examples. The disclosure can, however, be embodied in different forms and should not be construed as limited to the embodiments set forth herein. Given the teaching herein, one of ordinary skill in the art will be able to modify the disclosure for a desired purpose and such variations are considered within the scope of the disclosure.

SEQUENCE LISTING (392 sequences)

SEQ ID NO: 1 - DNA, 1958 bp, Homo sapiens
ccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaa

SEQ ID NO: 2 - DNA, 783 bp, Homo sapiens
agctcctaggtccctgtcctgtggaaatttgtggaccctgggcaccctctcttgctcccaaattttaatcggctcctggaaacctcaccccaaattggagataggcactcctcttgtagaacaaaaggctcaggttcagggagtgagggcctgaactgtgcccccaccctccaggaagggtccttcacggcctggctgcagggatcagtcacgtgtggcccttcattaggccctgccatataagccaagggcacggggtggccgggaactctctaggcaagaatcccggaggcagaggccatgctgaccgcagcggtgctgagctgtgccctgctgctggcactgcctgccacgcgaggagcccagatgggcttggcccccatggagggcatcagaaggcctgaccaggccctgctcccagagctcccaggcctgggcctgcgggccccactgaagaagacaactgcagaacaggcagaagaggatctgttgcaggaggctcaggccttggcagaggtactagacctgcaggaccgcgagccccgctcctcacgtcgctgcgtaaggctgcatgagtcctgcctgggacagcaggtgccttgctgtgacccatgtgccacgtgctactgccgcttcttcaatgccttctgctactgccgcaagctgggtactgccatgaatccctgcagccgcacctagctggccaacgtcagggtcggggctagggtaggggcaaggaaactcgaataaaggatgggaccaacaaaaaaaaaaaaaaaaaaa

SEQ ID NO: 3 - DNA, 1905 bp, Homo sapiens
ataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactttg

SEQ ID NO: 4 - DNA, 4194 bp, Homo sapiens
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaaaaaaaaaaaaaaaaa

SEQ ID NO: 5 - DNA, 1864 bp, Homo sapiens
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgacctatgagcctcagccccggaagccgagcgagcggccggcgcgctcatcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttaaaaaaaaaaaaaaaa

SEQ ID NO: 6 - DNA, 4760 bp, Homo sapiens
aaaatcccacgtgactggctctcctctcaggccatcatggcgtctcccagtgggaagggagcccgggcgctggaggctcctggctgcgggccccggccgctcgcccgggacctggtggactccgtggacgatgcggaggggctgtacgtggctgtggagcgctgcccgctgtgcaacactacccgccggcggctgacctgcgccaaatgcgttcagagcggcgatttcgtctacttcgacggccgcgaccgggagaggtttatcgacaagaaggaaaggttaagccgacttaagagcaagcaagaagaatttcagaaagaagtgttaaaagctatggaaggaaaatggataacagatcagttgagatggaaaataatgtcctgcaagatgaggattgaacagttaaaacaaacaatatgtaaaggaaatgaagaaatggagaaaaattctgaaggccttctcaaaaccaaggaaaagaatcagaagctttacagtcgagcacaacggcaccaagagaaaaaggagaagattcagaggcataatcgcaaacttggtgacctggtagaaaaaaagaccattgacttaagaagtcattatgagcgtctggcaaatcttcgacgatcccatatattagagctcacctctgtcatttttccaatcgaggaagtaaagacgggtgtgagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctgacatggagcagagtaaccctgcctacaccatcagtgctgcgctgtgctatgcaactcagctggtcaacattctgtctcatatacttgatgtaaatcttcccaaaaagctctgcaacagtgaattttgtggcgaaaatctaagcaagcagaaatttactcgagcagtgaagaaactgaatgcaaatattctttacctttgtttttctcagcatgtaaatttagatcaattacaaccactgcataccctcaggaatctaatgtacctggtcagtccaagctctgaacacctaggcaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccatctcaacctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctaggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagtaaaaaaaaaaaaaaaaaa

SEQ ID NO: 7 - DNA, 1167 bp, Homo sapiens
tgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgaaaaaaaa

SEQ ID NO: 8 - DNA, 8270 bp, Homo sapiens
aagagctcgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 9 - DNA, 4241 bp, Homo sapiens
actggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaaaaaaaaa

SEQ ID NO: 10 - DNA, 6492 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 11 - DNA, 5106 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagttaaaaaaa

SEQ ID NO: 12 - DNA, 3575 bp, Homo sapiens
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaaa

SEQ ID NO: 13 - DNA, 2655 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctaaaaaaaaaaaaaaaaaaaaaaaaa

SEQ ID NO: 14 - DNA, 4049 bp, Homo sapiens
agcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctaggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggcaaaaaaaaaaaaaaaaaa

SEQ ID NO: 15 - DNA, 1535 bp, Homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 16 - DNA, 4704 bp, Homo sapiens
acttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttcaaaaaaaaaaaaaaaaaaaaaaaaaa

SEQ ID NO: 17 - DNA, 2060 bp, Homo sapiens
atttttggccctcgtgacagtgattgatagctgctgggaaggtataaaagcagcttgcctgcgaaggttcttcacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaa

SEQ ID NO: 18 - DNA, 4209 bp, Homo sapiens
cttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatca

SEQ ID NO: 19 - DNA, 2300 bp, Homo sapiens
actcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaaca

SEQ ID NO: 20 - DNA, 2723 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtcaaaaaaaaaaa

SEQ ID NO: 21 - DNA, 3976 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacata

SEQ ID NO: 22 - DNA, 4304 bp, Homo sapiens
cacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaa

SEQ ID NO: 23 - DNA, 6531 bp, Homo sapiens
gcccagccagcttgcgtcaccgcttcagagcggagaagagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattaaaaaaaaaa

SEQ ID NO: 24 - DNA, 5489 bp, Homo sapiens
gaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacacaaaaaaaaaaaaaaaa

SEQ ID NO: 25 - DNA, 5748 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 26 - DNA, 5715 bp, Homo sapiens
cgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgacccccccccgcgcgcgcgcccggccaccggttggccccgggccagggcacaggtaccgcggctgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaatgatgtc

SEQ ID NO: 27 - DNA, 3193 bp, Homo sapiens
agaccccagccagtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 28 - DNA, 2122 bp, Homo sapiens
ggtggctattttgtccttgggctgcctgttttcagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaaaaaaaaaaaaaaaaaa

SEQ ID NO: 29 - DNA, 2535 bp, Homo sapiens
ttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaaaaaaaaaaaaaa

SEQ ID NO: 30 - DNA, 3878 bp, Homo sapiens
ggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacctgatattaagggaaactaaagaaaatgttattgtggatcccacagtactatattacactgttttttttgtttgttttgttagttttttttatttaaagcaaacctcaaacattattgggtatcaattaccacctggttgtattgaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataacaaaaaaaaaaaaaaaaaa

SEQ ID NO: 31 - DNA, 10540 bp, Homo sapiens
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagtgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcccggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccggagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggaggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgtgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctcccccgtcttctcccctcagcaattcctgcaaagggttaaaaatttaactggtttttactactgatgacttgatttaaaaaaaatacaaagatgctggatgctaacttggtactaaccatcagattgtacagtttggttgttgctgtaaatagggtagcgttttgttgttgttgttttttcatgccccatactactgaataaactagttctgtgcgggtacagca

SEQ ID NO: 32 - DNA, 10640 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttaaaaaaaaaaaaaaaaaa

SEQ ID NO: 33 - DNA, 5910 bp, Homo sapiens
agctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaa

SEQ ID NO: 34 - DNA, 1145 bp, Homo sapiens
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaaaaaaaaaaaaaaaaaaaaaaaaaaaaaa

SEQ ID NO: 35 - DNA, 2358 bp, Homo sapiens
aaactcacacaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaaaaaaaaaaaaaaaa

SEQ ID NO: 36 - DNA, 2141 bp, Homo sapiens
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtaaaaaaaaaaaaaaaaaa

SEQ ID NO: 37 - DNA, 1730 bp, Homo sapiens
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaa

SEQ ID NO: 38 - DNA, 4372 bp, Homo sapiens
ggtgcctccgggggcggggcctccttcggttggcggcctcgggcttcgggagtcctccaagaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaagaaaggtaaaaaaaaaaaaaaaaa

SEQ ID NO: 39 - DNA, 479 bp, Homo sapiens
acacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaagttaaaaaaaaaaa

SEQ ID NO: 40 - DNA, 1815 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 41 - DNA, 7110 bp, Homo sapiens
tgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgccta

SEQ ID NO: 42 - DNA, 6159 bp, Homo sapiens
cgcgggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcgtgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctacctta

SEQ ID NO: 43 - DNA, 2495 bp, Homo sapiens
ccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaacttaaatagaaaaaaaaaaaaaaaa

SEQ ID NO: 44 - DNA, 4866 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 45 - DNA, 4234 bp, Homo sapiens
cgtgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgaaaaaaaaaaaaaaa

SEQ ID NO: 46 - DNA, 4664 bp, Homo sapiens
gcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagctaaaaaaaaaaaaaaaaaa

SEQ ID NO: 47 - DNA, 5765 bp, Homo sapiens
actccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagcaaaaaaaa

SEQ ID NO: 48 - DNA, 4628 bp, Homo sapiens
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagaatatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattcccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcatatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatacagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggtgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcatctcaatcttggtttgtcagtttatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttgaagtaacttatttgactatgaatgttatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgac

SEQ ID NO: 49 - DNA, 6330 bp, Homo sapiens
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 50 - DNA, 3376 bp, Homo sapiens
ggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaaaaaaaa

SEQ ID NO: 51 - DNA, 1909 bp, Homo sapiens
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaaaaaaaaaaaaaaaaaaaaaaaaaaaaaaaaaaaaaaaaaaaaaaaaaaa

SEQ ID NO: 52 - DNA, 14773 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagctttaaaaaaaaaa

SEQ ID NO: 53 - DNA, 6800 bp, Homo sapiens
gctgcggccggctgcggggataaatactgcggcagctactgccgcgcagcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggattgcttgagcccaggagtctgaggtttgcagtgagctatgattgtgccactgcactccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctgagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggaatagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgagctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaacacaaaaaaaa

SEQ ID NO: 54 - DNA, 4654 bp, Homo sapiens
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaataaaaaaaaaaaaaaa

SEQ ID NO: 55 - DNA, 2428 bp, Homo sapiens
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataaaaaa

SEQ ID NO: 56 - DNA, 2579 bp, Homo sapiens
gcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttaaaaaaaaaaaaaaaaaa

SEQ ID NO: 57 - DNA, 3207 bp, Homo sapiens
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcaaaaaaaaaaaaaaaaaa

SEQ ID NO: 58 - DNA, 3551 bp, Homo sapiens
tttcaaacagcggaacaaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgaaaaaaaaaaaaaaaaaaa

SEQ ID NO: 59 - DNA, 1834 bp, Homo sapiens
ttgggaagggtttccagaaggtgggaaatgtcacctgattcacactgaacttttgaaagctccccacccccaaggagccgcgcacaccctcgctcgcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcac

SEQ ID NO: 60 - DNA, 3628 bp, Homo sapiens
agagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 61 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 62 - DNA, 1398 bp, Homo sapiens
ggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttcaaaaaaaaaaaaaaaaaa

SEQ ID NO: 63 - DNA, 1393 bp, Homo sapiens
tcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctctgaaaaaaaaaaaaaaaaaa

SEQ ID NO: 64 - DNA, 3618 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcagaaaaaaaaaaaaaaaaaa

SEQ ID NO: 65 - DNA, 8228 bp, Homo sapiens
ccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaaaaaaaaaaaaaaaa

SEQ ID NO: 66 - DNA, 4737 bp, Homo sapiens
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctgaaaaaaaaaaaaaaaaaa

SEQ ID NO: 67 - DNA, 8482 bp, Homo sapiens
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 68 - DNA, 2322 bp, Homo sapiens
gggagggggtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaaaaaaaaaaaa

SEQ ID NO: 69 - DNA, 3555 bp, Homo sapiens
ggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctag

SEQ ID NO: 70 - DNA, 4150 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagaaaaaaaaaaa

SEQ ID NO: 71 - DNA, 3241 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccggcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaaaa

SEQ ID NO: 72 - DNA, 914 bp, Homo sapiens
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcaaaaaaaaaaaaaaaaaa

SEQ ID NO: 73 - DNA, 1000 bp, Homo sapiens
actctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaaaaaaaaa

SEQ ID NO: 74 - DNA, 12262 bp, Homo sapiens
agtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcaaaaaaaaaaaaaaaaaaaaaaaaaaaa

SEQ ID NO: 75 - DNA, 1660 bp, Homo sapiens
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaa

SEQ ID NO: 76 - DNA, 2638 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaataaaaaaaa

SEQ ID NO: 77 - DNA, 2246 bp, Homo sapiens
aaagtccgggggagccggtcccgggcagccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgaaaaaaaaaaa

SEQ ID NO: 78 - DNA, 980 bp, Homo sapiens
gcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctgaaaaaaaaaaaaaa

SEQ ID NO: 79 - DNA, 2381 bp, Homo sapiens
actgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccttttgtttgttttttgagatggagtctcgctctgttgcctaggctggagtgcagtgaggcaatctgaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagttcgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaaaaa

SEQ ID NO: 80 - DNA, 1484 bp, Homo sapiens
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaaaaaaaaaa

SEQ ID NO: 81 - DNA, 1718 bp, Homo sapiens
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 82 - DNA, 5294 bp, Homo sapiens
ctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactcaaaaaaaaaaaaaaaaaa

SEQ ID NO: 83 - DNA, 9059 bp, Homo sapiens
gagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 84 - DNA, 5845 bp, Homo sapiens
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaaaaaaaaaaaa

SEQ ID NO: 85 - DNA, 1832 bp, Homo sapiens
gagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttaaaaaaaaaaaaaaaaa

SEQ ID NO: 86 - DNA, 3508 bp, Homo sapiens
tgagttgctgccttggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcg

SEQ ID NO: 87 - DNA, 7128 bp, Homo sapiens
aaaagcggcctctcggctgagggccggggagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgaaaaaaaaaaaaaaaaa

SEQ ID NO: 88 - DNA, 1655 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaa

SEQ ID NO: 89 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 90 - DNA, 4679 bp, Homo sapiens
gagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgccaaaaaaaaaaaaaaaaaa

SEQ ID NO: 91 - DNA, 1490 bp, Homo sapiens
agatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaaaaaaaaaaaaaaaaaaa

SEQ ID NO: 92 - DNA, 1077 bp, Homo sapiens
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 93 - DNA, 3620 bp, Homo sapiens
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 94 - DNA, 2073 bp, Homo sapiens
agatgccacgccccatagctccaccagtcaccgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaataaaaaaaaaaaaaaaaa

SEQ ID NO: 95 - DNA, 4625 bp, Homo sapiens
aaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaacaaaaaaaaaaaaaaaaaa

SEQ ID NO: 96 - DNA, 561 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 97 - DNA, 3549 bp, Homo sapiens
acatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaaaaaaaaaaaaaaaaaaaaaaaaa

SEQ ID NO: 98 - DNA, 2387 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 99 - DNA, 3470 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 100 - DNA, 2379 bp, Homo sapiens
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 101 - DNA, 2736 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgaaaaaaaaa

SEQ ID NO: 102 - DNA, 7852 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 103 - DNA, 1823 bp, Homo sapiens
gagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataaaaaaaaaaaaaaaaaa

SEQ ID NO: 104 - DNA, 2151 bp, Homo sapiens
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgaaaaaaaaaaaaaaaaaaaaaa

SEQ ID NO: 105 - DNA, 8716 bp, Homo sapiens
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccttctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctcttcccaccccacccttttatttttacacaaggagcatagtgttcatacttatgctatttttttcagtaactgaatatatttggagatctccctccctaggtcatagagctctgcccccttctctctaacagctgctcagccttctgtgactagaggtgctgtcaccagcttgccccatcccctcctggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactccagcctgggcgacagagtgagactccatctcaaataaataaagaggttatactgaataatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcgtgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgccccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagatggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaacacatcatcgccaacttttaattttgctaaataaggatattagaaaaagaatagaaaattgcagtcccttactgtttaaagaaaaaccaaaagaagttaaaaagaaaaaaaaaacaacctc

SEQ ID NO: 106 - DNA, 2095 bp, Homo sapiens
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaaaaaaaaaaaa

SEQ ID NO: 107 - DNA, 1669 bp, Homo sapiens
gctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccg

SEQ ID NO: 108 - DNA, 1857 bp, Homo sapiens
ccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgcaagctgtttccagagtgcaggagccaagtgctcggggaccctttgaaaagtgcctggggacctgaagagcaccggggaatttgtaacccctatttaagcctgcaagtgcctaagttaaaaaaaaaaaaaaaaaaaaaaaaaaaaaaaaaaaaaaaaaaaaaaaaaaaaaaa

SEQ ID NO: 109 - DNA, 4345 bp, Homo sapiens
actgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacaaaaaaaa

SEQ ID NO: 110 - DNA, 7556 bp, Homo sapiens
gcaggcgccttcgcggaccgagcctgacggagccggaggctgggagccgcggcggcctggggaagtgtttggattgtgagctatttcagaactgttctcaggactcattattttaacatttgggagaaacacagccagaagatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 111 - DNA, 2102 bp, Homo sapiens
ttgggggcggggcagaatcagcctttaagttgcagtgactctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtcaaaaaaaaaa

SEQ ID NO: 112 - DNA, 3039 bp, Homo sapiens
aataaagcgtgaacccgtccgtccggctcgcactttaagacttcccgagcggcggcggggacgccagtcgagccgggagacgcttacctgccgcttccccgcgccgcccggtgcacctggccgcaagggacctcgttctcagggaagacggcgacattccgcggaggtggaaccgccgcgcgccgtccgggctcggaccttccccggaacgtgggggcgccttagcgactccttccctgttgtgcccccgttcccggcgttcagcccggccccgcaaaggtgggacggctcccggcttcagttacggaagcggcccgtgtccagcgacgagggttcgaaaatgccccgcgcgttcctggtgaagaagccgtgcgtctccacgtgcaagaggaactggagcgagctccccgacgaggagcgcggcgagatctacgtgccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgtttaaaaaaaaaaaaaaaaa

SEQ ID NO: 113 - DNA, 2692 bp, Homo sapiens
tttaaagctgggaggttctgccaccaagcacggccttcccactgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcgcctctgtcaaagatcggcatcgagctgacggattcaccctacgtggtggccagcatgcggatcatgacgcggatgggcacgcccgtcctggaagcagtgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatgtgtgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaa

SEQ ID NO: 114 - DNA, 3393 bp, Homo sapiens
cctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcgggcgggcagacggaccgacggactcgcgccgcgtccacctgtcggccgggcccagccgagcgcgcagcgggcacgccgcgcgcgcggagcagccgtgcccgccgcccgggccccgcgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctcactcgggctcgggatccgcccaggtagcggcctcggacccaggtcctgcgcccaggtcctcccctgccccccagcgacggagccggggccgggggcggcggcgcccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaatgaaaaaaaaaaaaaaaaaa

SEQ ID NO: 115 - DNA, 3710 bp, Homo sapiens
aggacgcgtttccaagttccagtgactcctcctgtttgggactcggggggagagtgcggggagacaaataaaacctcgggcggcggcggctggtgggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaa

SEQ ID NO: 116 - DNA, 13037 bp, Homo sapiens
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccattatcagtagttatgtgacaattgtgtgtgtgtttaatgtttaaagatgtggcactttttaataaggcaatgctatgctattttttcccatttaacattaagataatttattgctatacagatgatatggaaatatgatgaacaatattttttttgccaaaactatgccttgtaagtagccatggaatgtcaacctgtaacttaaattatccacagatagtcatgtgtttgatgatgggcactgtggagataactgacataggactgtgccccccttctctgccacttactagctggatgagattaagcaagtcatttaactgctctgattaaacctgcctttcccaagtgctttgtaatgaatagaaatggaaaccaaaaaaaacgtatacaggccttcagaaatagtaattgctactattttgttttcattaagccatagttctggctataattttatcaaactcaccagctatattctacagtgaaagcaggattctagaaagtctcactgttttatttatgtcaccatgtgctatgatatatttggttgaattcatttgaaattagggctggaagtattcaagtaatttcttctgctgaaaaaatacagtgttttgagtttagggcctgttttatcaaagttctaaagagcctatcactcttccattgtagacattttaaaataatgacactgattttaacatttttaagtgtctttttagaacagagagcctgactagaacacagcccctccaaaaacccatgctcaaattatttttactatggcagcaattccacaaaagggaacaatgggtttagaaattacaatgaagtcatcaacccaaaaaacatccctatccctaagaaggttatgatataaaatgcccacaagaaatctatgtctgctttaatctgtcttttattgctttggaaggatggctattacatttttagtttttgctgtgaatacctgagcagtttctctcatccatacttatccttcacacatcagaagtcaggatagaatatgaatcattttaaaaacttttacaactccagagccatgtgcataagaagcattcaaaacttgccaaaacatacattttttttcaaatttaaagatactctatttttgtattcaatagctcaacaactgtggtccccactgataaagtgaagtggacaaggagacaagtaatggcataagtttgtttttcccaaagtatgcctgttcaatagccattggatgtgggaaatttctacatctcttaaaattttacagaaaatacatagccagatagtctagcaaaagttcaccaagtcctaaattgcttatccttacttcactaagtcatgaaatcattttaatgaaaagaacatcacctaggttttgtggtttctttttttcttattcatggctgagtgaaaacaacaatctctgtttctccctagcatctgtggactatttaatgtaccattattccacactctatggtccttactaaatacaaaattgaacaaaaagcagtaaaacaactgactcttcacccatattataaaatataatccaagccagattagtcaacatccataagatgaatccaagctgaactgggcctagattattgagttcaggttggatcacatccctatttattaataaacttaggaaagaaggccttacagaccatcagttagctggagctaatagaacctacacttctaaagttcggcctagaatcaatgtggccttaaaagctgaaaagaagcaggaaagaacagttttcttcaataatttgtccaccctgtcactggagaaaatttaagaatttgggggtgttggtagtaagttaaacacagcagctgttcatggcagaaattattcaatacataccttctctgaatatcctataaccaaagcaaagaaaaacaccaaggggtttgttctcctccttggagttgacctcattccaaggcagagctcaggtcacaggcacaggggctgcgcccaagcttgtccgcagccttatgcagctgtggagtctggaagactgttgcaggactgctggcctagtcccagaatgtcagcctcattttcgatttactggctcttgttgctgtatgtcatgctgaccttattgttaaacacaggtttgtttgctttttttccactcatggagacatgggagaggcattatttttaagctggttgaaagctttaaccgataaagcatttttagagaaatgtgaatcaggcagctaagaaagcatactctgtccattacggtaaagaaaatgcacagattattaactctgcagtgtggcattagtgtcctggtcaatattcggatagatatgaataaaatatttaaatggtattgtaaatagttttcaggacatatgctatagcttatttttattatcttttgaaattgctcttaatacatcaaatcctgatgtattcaatttatcagatataaattattctaaatgaagcccagttaaatgtttttgtcttgtcagttatatgttaagtttctgatctctttgtctatgacgtttactaatctgcatttttactgttatgaattattttagacagcagtggtttcaagctttttgccactaaaaataccttttattttctcctcccccagaaaagtctataccttgaagtatctatccaccaaactgtacttctattaagaaatagttattgtgttttcttaatgttttgttattcaaagacatatcaatgaaagctgctgagcagcatgaataacaattatatccacacagatttgatatattttgtgcagccttaacttgatagtataaaatgtcattgctttttaaataatagttagtcaatggacttctatcatagctttcctaaactaggttaagatccagagctttggggtcataatatattacatacaattaagttatctttttctaagggctttaaaattcatgagaataaccaaaaaaggtatgtggagagttaatacaaacataccatattcttgttgaaacagagatgtggctctgcttgttctccataaggtagaaatactttccagaatttgcctaaactagtaagccctgaatttgctatgattagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcgtggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgatcataaacatgaagaattgtaggtgatcatgacctcctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccaggtcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagcctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttcta

SEQ ID NO: 117 - DNA, 2693 bp, Homo sapiens
ggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaa

SEQ ID NO: 118 - DNA, 3508 bp, Homo sapiens
aagccccgccccgcgccctgcgtcgggttaagagggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcaggtaggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaacaaaaaaaaaaaaaaaaaa

SEQ ID NO: 119 - DNA, 1295 bp, Homo sapiens
ccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagc

SEQ ID NO: 120 - DNA, 1818 bp, Homo sapiens
ggcgcccgcgcccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 121 - DNA, 6318 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatcta

SEQ ID NO: 122 - DNA, 4790 bp, Homo sapiens
ggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgctctgaaaaagtttctgattctggagcattttggattttggattttcagattagggatgcttaacctggattaacattctgttgtgccatgatcatgctttacagtgagtgtattttatttatttattattttgtttgtttgtttgagatggagtctcactctgtcatccaggctagagtgcagtggcgtgatctcggctgactgcaacctctgcctcccgggttcaagtgattctcctgcctcaatctctctccccagaagctgggattacaggtgtgtgccaccacacccggctaatttttttttttttttttgagatggagtctagctctgtcatccaggctggagtgcagtggtgtgatctcggctccctgcaacctctgccttctgggttcctgcgattctcctgcctcagcctcctgagtagctgagattacaggcacgcgccactgtgcccagccaatttttgtatttttagtagagatggggtttcacatgtcagtcatgctggtcttgatctcctgacctcgtgatccacccgcctcgacctcccaaagtactgggattacaggcgtgagccaccgcatccggcctgagttttatgctttcaatgtatttcttacatttcagttcaagtgattttcatgtctcagcctcctgagtagctggaactacaggtgcgtgccaccatgcctggctaagttttgtatttttagtagagatgggttttcatcatgttggccaagatggtcttgatctcttgacctcatgatccaccagcctaggcctcccaaagtgctgggattacaggtgtgagccaccgtgcccagccaactatgccattatttaaccatgtccacacattctggttattttcaatattttgcagaagataattcttgatcggtgtgtcttatgccacaaggattaaaatatgtattcattgctacaaaacaatatctcgaaatttagcagtttaaaacaacaaatattatctccagtttctgagcctcagaaatctgagagtggtttagctgggtgatagtctcgtggttttggtcaagctaccaaccagggctacaatctttcgaaggtgtcattggggctagaagatctgcttcccgcaagactcacagctgttggcaggagacctcagtttgttgccacatgttcccctccagagggcctctcacaacatggcagttatttgtccccagagcaagcaacaccggagggcaaggaagaagccatgatgttttttgtaacctagcctctgaaagtgtcataccaattctgtattttgttggtcacacagaccaagtcaactacaacgtgggagactcctacacaaggcatgaattctaggaggtgggcatttttaagtgtcatctggaaggaggctgtcacaacctggaagttaaaagcattgatattctgaaatacagcgtgtataacattgttttagtagggtgtgcaatagttatgttttggtaatagcattaatgaacaatgttattttcatcttccagacatctggaagattgctctagtggagtaaaacatcttaatgtattttgtccctaaataaactatctcactaacaaaaaaaaaaaaaaa

SEQ ID NO: 123 - DNA, 4881 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggca

SEQ ID NO: 124 - DNA, 1641 bp, Homo sapiens
agagggcccgctcaccaccccgtaggccccgcccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagtaaaaaaaaaaaaaaaa

SEQ ID NO: 125 - DNA, 7957 bp, Homo sapiens
gcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 126 - DNA, 3773 bp, Homo sapiens
atccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtgaaagagcagctgaagcacagagaccatgtgtggggcgtgtggggtcactgggaagcactgggtctggtgttagacgcaggatggacccctggagggccctgctgctgctgcatcccctctcccgacccagctgtcatgggcctccctgat

SEQ ID NO: 127 - DNA, 1331 bp, Homo sapiens
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 128 - DNA, 1223 bp, Homo sapiens
cccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaaaaaaaaaaaaaaaaa

SEQ ID NO: 129 - DNA, 1785 bp, Homo sapiens
aggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcacttaaaaaaaaaaaaaaaaaaa

SEQ ID NO: 130 - DNA, 6582 bp, Homo sapiens
agagggcaaggagagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcgcaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccaggaaagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcaagtttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagttttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatactgggacttcagaagtgcaatgtatttttctcctgtgaaacctgaatctacaagttttcctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagccttttttttttttgtatttcagagaaaattcaggtaccaggatgcaatggatttatttgattcaggggacctgtgtttccatgtcaaatgttttcaaataaaatgaaatatgagtttcaatactttttatattttaatatttccattcattaatattatggttattgtcagcaattttatgtttgaatatttgaaataaaagtttaagatttgaaaa

SEQ ID NO: 131 - DNA, 2457 bp, Homo sapiens
attagatcagtgttcataagaacatctgtaggcacacatacacactctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgttctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatataagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaaaaaaaaaaaaaaaaaaaaaaaaaaaa

SEQ ID NO: 132 - DNA, 3301 bp, Homo sapiens
gtgcctcttgcagcagcctaacccagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaa

SEQ ID NO: 133 - DNA, 4903 bp, Homo sapiens
gtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaattaaaaaaaaaaaaaaaaaa

SEQ ID NO: 134 - DNA, 812 bp, Homo sapiens
gatataaagctcctactctgtctgacctgacaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttatttttatccagtgaaaaaa

SEQ ID NO: 135 - DNA, 4573 bp, Homo sapiens
agaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 136 - DNA, 450 bp, Homo sapiens
gtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccagaaaaaaaaaaaa

SEQ ID NO: 137 - DNA, 586 bp, Homo sapiens
aaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtcaaaaaaaaaa

SEQ ID NO: 138 - DNA, 5189 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacagcatttaaagttgtataaaaacatgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttattttagactcaaagaatataatctggcactactcagttattactgtttgttctcttattccctagtctgtgtggcaaattaaacaatataagaaggaaaaatttgaagtattagacttctaaataaggtgtgaaatcatcaaaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattccccaaaaaaaaaaaaaaaa

SEQ ID NO: 139 - DNA, 2164 bp, Homo sapiens
ataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 140 - DNA, 3212 bp, Homo sapiens
gaacccggtggctgcacagacaaaaaagccccgaatggctggagggcgttcagctgttaacagccttttggggcagagcacggatttgacagctccacaacgtgaggatatccactgaccccgcgagacggaggagaacgcttccccgaaattctctgcccaccaaagccagcgctgcaaggttgcaactttcaaactttgtttttccagaaagaagactgccctttcgtgtacaaggagagggtgagagggtgacctagcttgtagatcggctgaaggcaccagtggttccaaatgtcacccagatgtgtgttttcatgacgatttgatttctctgattttatttttacatttttcattttaaaaatacaaagcaatttttttggggcatgctgaaaggtaactgaagaccgcaaaggaaaaactattgtcatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaattttaaaaaaaaaaaaaaaaaa

SEQ ID NO: 141 - DNA, 2414 bp, Homo sapiens
ttttttataaggccgagcgcgcggcctggcgcagcatacgccgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttacatataaaaaaaa

SEQ ID NO: 142 - DNA, 4206 bp, Homo sapiens
ggggcctgcaggtttggcccccgcagggagcgcagctggcgccgctgggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaaaaaaaaaaaaaaa

SEQ ID NO: 143 - DNA, 4110 bp, Homo sapiens
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttaaaaaaaaaaaaaaaaa

SEQ ID NO: 144 - DNA, 7202 bp, Homo sapiens
gatgtgtgtggggttcggagccgcgccggcacagccgaagggagcgggcgagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatggattttatgggataataaatgtttttcatgttctcttataagatactatgtatgaaattacttcagagagctatatttattttaaaataaattagctagggttaaggttatattctatttccagcatagaaggtagataatctaatggtgtagaaagaatcactaggttgtcatttaaccagttattttcatattttgcttaatagtacatatccaaaaagaattttgtacttccccaaatgtaatttatttactaaattgagtataacctaaatgtgtgttttctattttccatttaaattttgctatattaagactaatttaattcgttgagtcttggaatcttctcaaggaggaacaaatattaaaatgacatgtagaaacaaatttttttttttttttttttttttttttttttgagacagagtctcgctgtctcccaggctggagttcagtggtgcaatctcggctcactgcaagctctgcctcctgggttcaagccattctcctgcctcagcctcccgagtagctgggactacaggcacccaccaccactcccggctaatttttagaaacaaatatttaaaatgacatattctcccaatacaatctatttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtttaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttaaaa

SEQ ID NO: 145 - DNA, 12021 bp, Homo sapiens
gggtgatgtcagctctcgacgaaaatagagagggatcgcctgcaaatccccagctccggcggggctaaaccttgcaatccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaatttaaaaaaaaaaaaaaaa

SEQ ID NO: 146 - DNA, 11623 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtagcaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccatacaaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaatttttttttctgtctctgtaatccctcctaccattaagaaaaacttatttcttagacattgtacaatcagttatgtactgaaaatcgaatgtgcttgtgtgatacttgtttcaggacaagttcatttgccaggttcattttgttagcatgagcctacggattctgatttcccaaagaaagaatgttttcctgtaggtatttttgtaccaccagtatatggaatgttagggaaaaactttgttccagttcctttttttttttctttctactttcaagtttaagtgaaccatactgaaatgaccaacaagtctgcctgtaaagttacatgtcatgattgtgttgttaaatgattatgggggagaaaatgaagtaaatgttgctgatgatccccatatttattgatcatattaaggttgtttatatagtttggaaatgaccagccccctaagcagtgtttgattaacttatgctaatcagatgattactcatatattctgctaattttctagctttattcttgttatttggaaaaattattagccaaatgccttcctaggtggatccagttggaagatatgtccagaaacctgaagaaaaattgacgctgcctttgtgtgctggattgctctacttgattagatcatgatatatcaaggttgaatttttagagggaaaatttaattctgatatcttattgcatccttgataagtttttccctgattttttttttcctcaaaagactttccatctgtacacagcctctacatttttgttgtagtgacttagagcataaggatgtttcagtgcaaactggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacattactgtgtaattcactgataattgacatattggctgggcagcctatctcttccatatccagcgtaaatgaataggaggtgtttgtgattttttttttctccctttatttaacattgagtcctagtagtttggagaattagggtccctctaccttctttctgctcttgtcttagtaagatacataaggtacatcatcttgtgtctgtgtgtatatagcagtaggtcaagtttagagtactaaagtctgtaaataaggaatgactattagcatattcattagaattgtttattcttgccagtataaacatcattttatttagactaaagtccctgaagcttgtctttcttattgcttcccagtaatagataatgtgctcgagtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcatattttgtgggacctctaatttccctggtcatctttcagaatattctgttctgccacccccagagagtaaacacttgagccgatttcttcttccccagctattctttcctgggggtaattatgctttgtctttagattagagaagcatcaagcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctgtcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttata

SEQ ID NO: 147 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 148 - DNA, 7014 bp, Homo sapiens
atccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgc

SEQ ID NO: 149 - DNA, 2886 bp, Homo sapiens
cgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaaaaaaaaa

SEQ ID NO: 150 - DNA, 3088 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 151 - DNA, 1722 bp, Homo sapiens
attcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaaaaaaaaaaaaa

SEQ ID NO: 152 - DNA, 2112 bp, Homo sapiens
aaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaa

SEQ ID NO: 153 - DNA, 981 bp, Homo sapiens
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaaaaaaaaaaaaaaaaa

SEQ ID NO: 154 - DNA, 1593 bp, Homo sapiens
gcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagtt

SEQ ID NO: 155 - DNA, 3963 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaa

SEQ ID NO: 156 - DNA, 1963 bp, Homo sapiens
cggggcgagcgagcggggcgcggcgaggggcaagggcggggagggccccggcgctcagagcaggcgccagggaggcaggctgggcggcccttcgtcctcgccttcgggtgtccatgcctcggcggcggcgtcccgctccgcagccaggggcctgcaagccgtagccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgaaaaaaaaaaaaaaaaa

SEQ ID NO: 157 - DNA, 1616 bp, Homo sapiens
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaaaaaaaaaa

SEQ ID NO: 158 - DNA, 3286 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctgaaaaaaaaaa

SEQ ID NO: 159 - DNA, 4814 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctaaaaaaaaaaaaaaaaaaaaaaaaaaaaaaa

SEQ ID NO: 160 - DNA, 1661 bp, Homo sapiens
cggccgctgggtccgtgaaggggagtgaggcactcctcaccctgtggcagctcctagtcaggaggcctctcccctccacctgcacgtcatgtggctgtggctcccaggaccagcgcctggagcgggtgagtgaacgtccctctcctccgtgggcactgcctccgctgtgagccacccttcaggctacgtgcatttccgcctgttctcagggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggcgaggccccacaggagaatcgatggttctgatgctgtcagcctctgggtgcaaattctgagggcccgggagcgtctggcggccctgagcagcttgctggggaagctccgtggaggaggaagtccggaggcatgtgatgtgaatcagctgacatcatcttgacgggagccctgtgaggcggacacttaactccagtttcacaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaacaaaaaaaaaaaaaaaaaa

SEQ ID NO: 161 - DNA, 4004 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 162 - DNA, 2174 bp, Homo sapiens
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 163 - DNA, 508 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaa

SEQ ID NO: 164 - DNA, 931 bp, Homo sapiens
tttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaaaaaaaaaaaaaaaa

SEQ ID NO: 165 - DNA, 5174 bp, Homo sapiens
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaa

SEQ ID NO: 166 - DNA, 1953 bp, Homo sapiens
acagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaatttaatatga

SEQ ID NO: 167 - DNA, 2396 bp, Homo sapiens
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaaaaaaaaa

SEQ ID NO: 168 - DNA, 5744 bp, Homo sapiens
gtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 169 - DNA, 3214 bp, Homo sapiens
gtggcgtgccggccaatcggcgcagctctttcctgcatatattttgcactaagactgggagtcctggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 170 - DNA, 2979 bp, Homo sapiens
gtggctcttctggcccgggctactatatagagacgtttccgcctcctgcttgaaactaacccctctttttctccaaaggagtgcttgtggagatcggatcttttctccagcaattgggggaaagaaggctttttctctgaattagcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaaaaaaaaaaaaaaaaaaaaaaaa

SEQ ID NO: 171 - DNA, 3677 bp, Homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 172 - DNA, 1433 bp, Homo sapiens
tgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgaaaaaaaaaaaaaaaaaaaaaaaaaaaaaa

SEQ ID NO: 173 - DNA, 1820 bp, Homo sapiens
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 174 - DNA, 6696 bp, Homo sapiens
atgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgttaaaaaaaaaaaaaaaaaaaa

SEQ ID NO: 175 - DNA, 3207 bp, Homo sapiens
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcaaaaaaaaaaaaaaaaaa

SEQ ID NO: 176 - DNA, 2301 bp, Homo sapiens
tccagtgagttgcaagcctaatgctcacctgcagagacagaattcctgagtgaacgaacagagcagctcctcttccatctccagggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaa

SEQ ID NO: 177 - DNA, 19 bp, Homo sapiens
tgccttcctccgctgaaac

SEQ ID NO: 178 - DNA, 18 bp, Homo sapiens
accacgcaccagtgtgac

SEQ ID NO: 179 - DNA, 24 bp, Homo sapiens
tcccaacttcttctggagcctggg

SEQ ID NO: 180 - DNA, 22 bp, Homo sapiens
gaaatgaaggagaagtttagca

SEQ ID NO: 181 - DNA, 23 bp, Homo sapiens
gctttataacaggataccatgac

SEQ ID NO: 182 - DNA, 29 bp, Homo sapiens
acagatgcaccatcaggaatggaattaca

SEQ ID NO: 183 - DNA, 20 bp, Homo sapiens
gaagctgacctggaagagaa

SEQ ID NO: 184 - DNA, 22 bp, Homo sapiens
ccacagaatttagctcggtatg

SEQ ID NO: 185 - DNA, 26 bp, Homo sapiens
cctatcaagtttgagctttctggctg

SEQ ID NO: 186 - DNA, 19 bp, Homo sapiens
gagactctcagggtcgaaa

SEQ ID NO: 187 - DNA, 19 bp, Homo sapiens
ctgtgggcggattagggct

SEQ ID NO: 188 - DNA, 24 bp, Homo sapiens
atttctaccactccaaacgccggc

SEQ ID NO: 189 - DNA, 20 bp, Homo sapiens
tgagggagaacaagaccgat

SEQ ID NO: 190 - DNA, 19 bp, Homo sapiens
actagtaggtgtgcagaga

SEQ ID NO: 191 - DNA, 23 bp, Homo sapiens
cactgcgcccttaactgcatcca

SEQ ID NO: 192 - DNA, 21 bp, Homo sapiens
gcgaattcagcatctgcaaag

SEQ ID NO: 193 - DNA, 18 bp, Homo sapiens
ctttcttcgggcaggctt

SEQ ID NO: 194 - DNA, 25 bp, Homo sapiens
accacaagcacctagaccatgaggt

SEQ ID NO: 195 - DNA, 20 bp, Homo sapiens
gtcggccaagttgatgaatg

SEQ ID NO: 196 - DNA, 21 bp, Homo sapiens
gatgagcgtgaagtggatttg

SEQ ID NO: 197 - DNA, 23 bp, Homo sapiens
ccattgacgaggaggaggaggat

SEQ ID NO: 198 - DNA, 21 bp, Homo sapiens
tgtggtcaagactggatgatg

SEQ ID NO: 199 - DNA, 20 bp, Homo sapiens
cagaagtggcttcgaaatga

SEQ ID NO: 200 - DNA, 24 bp, Homo sapiens
tctctaggaagcctcacttggccg

SEQ ID NO: 201 - DNA, 21 bp, Homo sapiens
aatggaacagcccttctacca

SEQ ID NO: 202 - DNA, 21 bp, Homo sapiens
gctcggtttcaggagtttgta

SEQ ID NO: 203 - DNA, 23 bp, Homo sapiens
tcatacacagctacgggatacgg

SEQ ID NO: 204 - DNA, 21 bp, Homo sapiens
gttgcttcaaggacacattag

SEQ ID NO: 205 - DNA, 20 bp, Homo sapiens
gcagatgagccctcagattt

SEQ ID NO: 206 - DNA, 24 bp, Homo sapiens
tgccctcactgcaacagagcattt

SEQ ID NO: 207 - DNA, 19 bp, Homo sapiens
gaaggaggagggcagaatc

SEQ ID NO: 208 - DNA, 20 bp, Homo sapiens
gtctcgattggatggcagta

SEQ ID NO: 209 - DNA, 26 bp, Homo sapiens
agttcatggatgtctatcagcgcagc

SEQ ID NO: 210 - DNA, 20 bp, Homo sapiens
ccacaaatcagacggcagca

SEQ ID NO: 211 - DNA, 20 bp, Homo sapiens
gtcgtagtaatggccatcgg

SEQ ID NO: 212 - DNA, 25 bp, Homo sapiens
cccatgatggctcagaccaacaagt

SEQ ID NO: 213 - DNA, 18 bp, Homo sapiens
gctgctgtggaagaaact

SEQ ID NO: 214 - DNA, 21 bp, Homo sapiens
gccctttgtctgacagaatta

SEQ ID NO: 215 - DNA, 22 bp, Homo sapiens
tgccagtaccacttctccgagc

SEQ ID NO: 216 - DNA, 18 bp, Homo sapiens
cctttcttggcccttgtt

SEQ ID NO: 217 - DNA, 19 bp, Homo sapiens
aaggttgctttgccatttg

SEQ ID NO: 218 - DNA, 24 bp, Homo sapiens
tgactctcggactgagaaacgcaa

SEQ ID NO: 219 - DNA, 17 bp, Homo sapiens
agcggcttcagcagatc

SEQ ID NO: 220 - DNA, 17 bp, Homo sapiens
gcctggagcccagatac

SEQ ID NO: 221 - DNA, 22 bp, Homo sapiens
actagcagcatgttgagccggg

SEQ ID NO: 222 - DNA, 18 bp, Homo sapiens
cctgcagtctctctgtgt

SEQ ID NO: 223 - DNA, 20 bp, Homo sapiens
gccacttttggagtacttgt

SEQ ID NO: 224 - DNA, 24 bp, Homo sapiens
taccaacgagctgaagcagatgca

SEQ ID NO: 225 - DNA, 18 bp, Homo sapiens
gagccgtgagcagtttag

SEQ ID NO: 226 - DNA, 22 bp, Homo sapiens
gatcacactaaggttgcatttc

SEQ ID NO: 227 - DNA, 21 bp, Homo sapiens
aaacggtcctcatggcctgca

SEQ ID NO: 228 - DNA, 18 bp, Homo sapiens
aagtttctccgcaccaag

SEQ ID NO: 229 - DNA, 21 bp, Homo sapiens
ctgggaaccagtgatgtttat

SEQ ID NO: 230 - DNA, 21 bp, Homo sapiens
agcgacagctgcagaccttca

SEQ ID NO: 231 - DNA, 20 bp, Homo sapiens
acaggttcttggctcttatg

SEQ ID NO: 232 - DNA, 22 bp, Homo sapiens
tgcagtcttcttcaactattct

SEQ ID NO: 233 - DNA, 25 bp, Homo sapiens
acatttgtcttgcattggagtctgt

SEQ ID NO: 234 - DNA, 19 bp, Homo sapiens
cggttctgtggagcagacg

SEQ ID NO: 235 - DNA, 24 bp, Homo sapiens
cttcatcaagcagtgatgtatctg

SEQ ID NO: 236 - DNA, 23 bp, Homo sapiens
cctggcctcagaagacgtcaaac

SEQ ID NO: 237 - DNA, 21 bp, Homo sapiens
gatatgggattggtcaagtcg

SEQ ID NO: 238 - DNA, 20 bp, Homo sapiens
cgctcgtgttcctcatgctg

SEQ ID NO: 239 - DNA, 22 bp, Homo sapiens
ttaaacacccgaagcgcacggc

SEQ ID NO: 240 - DNA, 20 bp, Homo sapiens
cagaagaccgaaaggatgga

SEQ ID NO: 241 - DNA, 19 bp, Homo sapiens
ggcacaacaccacgttatc

SEQ ID NO: 242 - DNA, 22 bp, Homo sapiens
acgaagcggccaagctgctcaa

SEQ ID NO: 243 - DNA, 20 bp, Homo sapiens
ctcggtcatgaagggcttca

SEQ ID NO: 244 - DNA, 19 bp, Homo sapiens
ccgcagagaacggaggtag

SEQ ID NO: 245 - DNA, 22 bp, Homo sapiens
acgctggtggtgatggagctga

SEQ ID NO: 246 - DNA, 21 bp, Homo sapiens
ctgattccactaggaccagac

SEQ ID NO: 247 - DNA, 23 bp, Homo sapiens
ctctgttctcgttccaaattctc

SEQ ID NO: 248 - DNA, 24 bp, Homo sapiens
cccggcacacaacacttggtttgc

SEQ ID NO: 249 - DNA, 22 bp, Homo sapiens
gacagtgagatatccagtgatg

SEQ ID NO: 250 - DNA, 20 bp, Homo sapiens
cttactgcccacacgataag

SEQ ID NO: 251 - DNA, 25 bp, Homo sapiens
catgacggacagcagtgtagatgga

SEQ ID NO: 252 - DNA, 23 bp, Homo sapiens
caatgcctttgatggaccaatta

SEQ ID NO: 253 - DNA, 22 bp, Homo sapiens
gggtagatgtcttcaggattcg

SEQ ID NO: 254 - DNA, 24 bp, Homo sapiens
tgatggcacccgctatgtccagaa

SEQ ID NO: 255 - DNA, 20 bp, Homo sapiens
actttccagcagttgcttag

SEQ ID NO: 256 - DNA, 21 bp, Homo sapiens
ggcaaagtggaaaatgcattg

SEQ ID NO: 257 - DNA, 24 bp, Homo sapiens
tccgatcgctgaatttggcttgga

SEQ ID NO: 258 - DNA, 22 bp, Homo sapiens
acattccactgggaaaattcta

SEQ ID NO: 259 - DNA, 17 bp, Homo sapiens
gcttgtccttggcagag

SEQ ID NO: 260 - DNA, 25 bp, Homo sapiens
taccgggctggcatgatcatagaca

SEQ ID NO: 261 - DNA, 19 bp, Homo sapiens
ttcgggtagtggaaaacca

SEQ ID NO: 262 - DNA, 21 bp, Homo sapiens
catagttcctgttggtgaagc

SEQ ID NO: 263 - DNA, 22 bp, Homo sapiens
ctcccgcgacgatgcccctcaa

SEQ ID NO: 264 - DNA, 20 bp, Homo sapiens
ggcagccttcctgatttctg

SEQ ID NO: 265 - DNA, 21 bp, Homo sapiens
ggtggaaaggtttggagtatg

SEQ ID NO: 266 - DNA, 24 bp, Homo sapiens
cagctctgtgtgaaggtgcagttt

SEQ ID NO: 267 - DNA, 17 bp, Homo sapiens
gaccagtacccgcactt

SEQ ID NO: 268 - DNA, 17 bp, Homo sapiens
cgcttctcgctctcgtt

SEQ ID NO: 269 - DNA, 22 bp, Homo sapiens
cgctgggcaagctctggagact

SEQ ID NO: 270 - DNA, 22 bp, Homo sapiens
tcactgagttcatggaaaactg

SEQ ID NO: 271 - DNA, 21 bp, Homo sapiens
gttcatctcggacaggtactt

SEQ ID NO: 272 - DNA, 23 bp, Homo sapiens
ccttcctccggctcaacgatggg

SEQ ID NO: 273 - DNA, 21 bp, Homo sapiens
gttacatcagcatcggacttg

SEQ ID NO: 274 - DNA, 20 bp, Homo sapiens
gagtcttcgacctggttctt

SEQ ID NO: 275 - DNA, 25 bp, Homo sapiens
agtccctgggaccctctcgatctta

SEQ ID NO: 276 - DNA, 17 bp, Homo sapiens
tccgctgctttcctcag

SEQ ID NO: 277 - DNA, 21 bp, Homo sapiens
gcagatgccaactagcataaa

SEQ ID NO: 278 - DNA, 23 bp, Homo sapiens
tacccggctgtgatggccttgtg

SEQ ID NO: 279 - DNA, 20 bp, Homo sapiens
aagctggaacagccagaatt

SEQ ID NO: 280 - DNA, 23 bp, Homo sapiens
catcaaagatgactgcagtagct

SEQ ID NO: 281 - DNA, 22 bp, Homo sapiens
tcctaggcaaggccaagcgagc

SEQ ID NO: 282 - DNA, 19 bp, Homo sapiens
agaggatgcaagctcaagt

SEQ ID NO: 283 - DNA, 22 bp, Homo sapiens
aataacaggaccttctgcaatg

SEQ ID NO: 284 - DNA, 24 bp, Homo sapiens
tgggctcaacaagggctttcactt

SEQ ID NO: 285 - DNA, 20 bp, Homo sapiens
ccctggtgcttctatcctaa

SEQ ID NO: 286 - DNA, 20 bp, Homo sapiens
atccctgcagaagtgtctaa

SEQ ID NO: 287 - DNA, 21 bp, Homo sapiens
accatcgacgtccctccagaa

SEQ ID NO: 288 - DNA, 20 bp, Homo sapiens
aagaggttcttgccagatga

SEQ ID NO: 289 - DNA, 22 bp, Homo sapiens
ggagaattccgtgaagtaacag

SEQ ID NO: 290 - DNA, 26 bp, Homo sapiens
tctctgggaattgtgttggctgtgga

SEQ ID NO: 291 - DNA, 20 bp, Homo sapiens
tggcagatcccacaggagtt

SEQ ID NO: 292 - DNA, 24 bp, Homo sapiens
agcccttccaaaggaattgtatta

SEQ ID NO: 293 - DNA, 30 bp, Homo sapiens
agcttcaagttagccaagaagagttcctct

SEQ ID NO: 294 - DNA, 25 bp, Homo sapiens
ctgccaagagaatatttggtgataa

SEQ ID NO: 295 - DNA, 25 bp, Homo sapiens
tggatacctaactaggttctgaatg

SEQ ID NO: 296 - DNA, 24 bp, Homo sapiens
acaaagacgagcaggactaaacga

SEQ ID NO: 297 - DNA, 21 bp, Homo sapiens
gccatgaggaagtggttgaaa

SEQ ID NO: 298 - DNA, 20 bp, Homo sapiens
tgctcaacatgacgcttgtc

SEQ ID NO: 299 - DNA, 24 bp, Homo sapiens
aagccgtgtcatgttcctgctggt

SEQ ID NO: 300 - DNA, 17 bp, Homo sapiens
ccaactgcgaccgcaac

SEQ ID NO: 301 - DNA, 18 bp, Homo sapiens
gtcttccggtccacacac

SEQ ID NO: 302 - DNA, 24 bp, Homo sapiens
caagcagtgtcacccagctctgga

SEQ ID NO: 303 - DNA, 19 bp, Homo sapiens
ccggatgacatcagagcta

SEQ ID NO: 304 - DNA, 22 bp, Homo sapiens
aatgcaaatatcagtgttcgtc

SEQ ID NO: 305 - DNA, 26 bp, Homo sapiens
tctcagaaagcagaggctcagagctt

SEQ ID NO: 306 - DNA, 21 bp, Homo sapiens
ggcattcttggcatctgtatt

SEQ ID NO: 307 - DNA, 22 bp, Homo sapiens
gcttgtaaatgactcccttgtt

SEQ ID NO: 308 - DNA, 24 bp, Homo sapiens
tggtggtggtgtccatttggcttt

SEQ ID NO: 309 - DNA, 20 bp, Homo sapiens
ggattctggcggtattgact

SEQ ID NO: 310 - DNA, 21 bp, Homo sapiens
catgactgggtccaagttgtc

SEQ ID NO: 311 - DNA, 30 bp, Homo sapiens
tcagagtctgatatcctgttgggcattctg

SEQ ID NO: 312 - DNA, 20 bp, Homo sapiens
gtttgagtccatgcccaatc

SEQ ID NO: 313 - DNA, 19 bp, Homo sapiens
gatcccacgtccgtagaaa

SEQ ID NO: 314 - DNA, 22 bp, Homo sapiens
cgccagctgtgtgactgcctgt

SEQ ID NO: 315 - DNA, 20 bp, Homo sapiens
agcttcgatgatgggcttac

SEQ ID NO: 316 - DNA, 20 bp, Homo sapiens
cctgatcatggagggtcaaa

SEQ ID NO: 317 - DNA, 22 bp, Homo sapiens
caactgggcgaagagggtgcca

SEQ ID NO: 318 - DNA, 18 bp, Homo sapiens
ggtccggaaagcactcaa

SEQ ID NO: 319 - DNA, 17 bp, Homo sapiens
tccgtagggctggtaca

SEQ ID NO: 320 - DNA, 23 bp, Homo sapiens
tcctacaactgccccagccccta

SEQ ID NO: 321 - DNA, 21 bp, Homo sapiens
cagtacatgctggtggttcac

SEQ ID NO: 322 - DNA, 21 bp, Homo sapiens
ttcgaggcgtgagtatgactt

SEQ ID NO: 323 - DNA, 24 bp, Homo sapiens
actggcgagaagccacacaagtgc

SEQ ID NO: 324 - DNA, 21 bp, Homo sapiens
cttcttcatggccgcgttaat

SEQ ID NO: 325 - DNA, 21 bp, Homo sapiens
aatgagcagaaccatggcaaa

SEQ ID NO: 326 - DNA, 24 bp, Homo sapiens
tccaggcagcggtagtagtggtgt

SEQ ID NO: 327 - DNA, 18 bp, Homo sapiens
ctccactgcccacctagt

SEQ ID NO: 328 - DNA, 21 bp, Homo sapiens
ctcctgccagtgcatgaattt

SEQ ID NO: 329 - DNA, 24 bp, Homo sapiens
atcacagcaggcaggctcccaatg

SEQ ID NO: 330 - DNA, 19 bp, Homo sapiens
acaccgacaactccatcaa

SEQ ID NO: 331 - DNA, 20 bp, Homo sapiens
cgcaagatgtgctcaatgaa

SEQ ID NO: 332 - DNA, 22 bp, Homo sapiens
tggagtgggaactggtggtgct

SEQ ID NO: 333 - DNA, 17 bp, Homo sapiens
ccctcccagcccaattc

SEQ ID NO: 334 - DNA, 19 bp, Homo sapiens
gggcacgtagagtgtttga

SEQ ID NO: 335 - DNA, 26 bp, Homo sapiens
tgccgtagacatctggactcagtgct

SEQ ID NO: 336 - DNA, 17 bp, Homo sapiens
gacaccctgagcgattc

SEQ ID NO: 337 - DNA, 19 bp, Homo sapiens
gaatgtggtgacagccttg

SEQ ID NO: 338 - DNA, 29 bp, Homo sapiens
tgaagatgatgaagaggaagatgaagagg

SEQ ID NO: 339 - DNA, 22 bp, Homo sapiens
agcctatgagggaaagtgtatc

SEQ ID NO: 340 - DNA, 22 bp, Homo sapiens
cccaaccttgaaatcccataaa

SEQ ID NO: 341 - DNA, 30 bp, Homo sapiens
agcaaagtcctgtgaagatatccagtgcac

SEQ ID NO: 342 - DNA, 20 bp, Homo sapiens
gggcaggagaggttcaaatg

SEQ ID NO: 343 - DNA, 20 bp, Homo sapiens
cagccactgcttggtatgtt

SEQ ID NO: 344 - DNA, 30 bp, Homo sapiens
tcttcaacctgaatgatgtggcatctctgg

SEQ ID NO: 345 - DNA, 22 bp, Homo sapiens
cctgtaccaattgatgccagac

SEQ ID NO: 346 - DNA, 25 bp, Homo sapiens
cggatacgtagggctactagataag

SEQ ID NO: 347 - DNA, 28 bp, Homo sapiens
acgatccatctccgattcctccattgca

SEQ ID NO: 348 - DNA, 25 bp, Homo sapiens
ggtgaggatttggataaatctgatg

SEQ ID NO: 349 - DNA, 22 bp, Homo sapiens
tcaaccacaaggtccaagaaac

SEQ ID NO: 350 - DNA, 25 bp, Homo sapiens
acatgggccgaggcaagataagcaa

SEQ ID NO: 351 - DNA, 23 bp, Homo sapiens
ccagacgtgatgacaagattgag

SEQ ID NO: 352 - DNA, 20 bp, Homo sapiens
gcgaggtaatttgtgccctt

SEQ ID NO: 353 - DNA, 25 bp, Homo sapiens
cccaacttccttagtgcctgtgaca

SEQ ID NO: 354 - DNA, 21 bp, Homo sapiens
attcaaagagctggtgcgaaa

SEQ ID NO: 355 - DNA, 21 bp, Homo sapiens
aggtcctccatgatgtgttct

SEQ ID NO: 356 - DNA, 34 bp, Homo sapiens
ctgcaaaattttctcaagaaggagaataagaatg

SEQ ID NO: 357 - DNA, 18 bp, Homo sapiens
ccaaccgcgagaagatga

SEQ ID NO: 358 - DNA, 20 bp, Homo sapiens
ccagaggcgtacagggatag

SEQ ID NO: 359 - DNA, 23 bp, Homo sapiens
ccatgtacgttgctatccaggct

SEQ ID NO: 360 - DNA, 19 bp, Homo sapiens
agtcctgagtccggatgaa

SEQ ID NO: 361 - DNA, 18 bp, Homo sapiens
cctccctcagtcgtctct

SEQ ID NO: 362 - DNA, 24 bp, Homo sapiens
tgacggagggtggcatcaaatacc

SEQ ID NO: 363 - DNA, 22 bp, Homo sapiens
gccagcttgtcttcaatgaaat

SEQ ID NO: 364 - DNA, 21 bp, Homo sapiens
caaagccagcttctgttcaag

SEQ ID NO: 365 - DNA, 24 bp, Homo sapiens
atccaccatgagttggtaggcagc

SEQ ID NO: 366 - DNA, 23 bp, Homo sapiens
gccaagaagaaagtgaacatcat

SEQ ID NO: 367 - DNA, 20 bp, Homo sapiens
atagggattccgggagtcat

SEQ ID NO: 368 - DNA, 24 bp, Homo sapiens
tcagaacaacagcctgccacctta

SEQ ID NO: 369 - DNA, 22 bp, Homo sapiens
tgactccttcaacaccttcttc

SEQ ID NO: 370 - DNA, 18 bp, Homo sapiens
tgccagtgcgaacttcat

SEQ ID NO: 371 - DNA, 24 bp, Homo sapiens
ccgggctgtgtttgtagacttgga

SEQ ID NO: 372 - DNA, 17 bp, Homo sapiens
agccacatcatccctgt

SEQ ID NO: 373 - DNA, 22 bp, Homo sapiens
cgtagatgttatgtctgctcat

SEQ ID NO: 374 - DNA, 22 bp, Homo sapiens
tttagcagcatctgcaacccgc

SEQ ID NO: 375 - DNA, 24 bp, Homo sapiens
gaggatttggaaagggtgtttatt

SEQ ID NO: 376 - DNA, 21 bp, Homo sapiens
acagagggctacaatgtgatg

SEQ ID NO: 377 - DNA, 26 bp, Homo sapiens
acgtcttgctcgagatgtgatgaagg

SEQ ID NO: 378 - DNA, 18 bp, Homo sapiens
taaaccctgcgtggcaat

SEQ ID NO: 379 - DNA, 27 bp, Homo sapiens
acatttcggataatcatccaatagttg

SEQ ID NO: 380 - DNA, 24 bp, Homo sapiens
aagtagttggacttccaggtcgcc

SEQ ID NO: 381 - DNA, 17 bp, Homo sapiens
ccgtggccttagctgtg

SEQ ID NO: 382 - DNA, 21 bp, Homo sapiens
ctgctggatgacgtgagtaaa

SEQ ID NO: 383 - DNA, 24 bp, Homo sapiens
tctctctttctggcctggaggcta

SEQ ID NO: 384 - DNA, 25 bp, Homo sapiens
aaatgttaacaaatgtggcaattat

SEQ ID NO: 385 - DNA, 20 bp, Homo sapiens
aacaatgcctccactccaaa

SEQ ID NO: 386 - DNA, 20 bp, Homo sapiens
tccacacaacaccaggactt

SEQ ID NO: 387 - DNA, 22 bp, Homo sapiens
tgaaaactacccctaaaagcca

SEQ ID NO: 388 - DNA, 21 bp, Homo sapiens
tatccaagacccaggcatact

SEQ ID NO: 389 - DNA, 21 bp, Homo sapiens
tagattcgggcaagtccacca

SEQ ID NO: 390 - DNA, 20 bp, Homo sapiens
aagatgaggcagaggtccaa

SEQ ID NO: 391 - DNA, 20 bp, Homo sapiens
tccagaatgtcacaggtcca

SEQ ID NO: 392 - DNA, 20 bp, Homo sapiens
tgctggtacaagttgtggga

The invention claimed is:

1. A method for administering a course of treatment to a subject in response to an assigned risk of breast cancer for that subject, comprising:
   a. calculating an activity level of a transforming growth factor-β (TGF-β) cellular signaling pathway in a sample isolated from the subject, wherein the TGF-β cellular signaling pathway activity is calculated by:
      i. calculating an activity level of a TGF-β transcription factor element in the sample, wherein the TGF-β transcription factor element comprises a SMAD family member, and wherein the activity level of the TGF-β transcription factor element in the sample is calculated by:
         1. Obtaining, by using at least one of Polymerase Chain Reaction (PCR), a microarray technique, and RNA-sequencing, data on the expression levels of at least three TGF-β target genes derived from the sample, wherein the TGF-β transcription factor element controls transcription of the at least three TGF-β target genes,
         2. calculating the activity level of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and,
      ii. calculating the activity level of the TGF-β cellular signaling pathway in the sample based on the calculated activity level of the TGF-β transcription factor element in the sample; and,
   b. calculating an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity level of the at least one additional cellular signaling pathway is calculated by:
i. calculating an activity level of a transcription factor element from the additional cellular signaling pathway in the sample, wherein the PI3K signaling pathway transcription factor element comprises a FOXO family member, the Wnt signaling pathway transcription factor element comprises β-catenin/TCF4, the ER signaling pathway transcription factor element comprises an ERα dimer, and the HH signaling pathway transcription factor element comprises a GLI family member, and wherein the activity level of the transcription factor element of the at least one additional cellular signaling pathway is calculated by:
1. Obtaining, by using at least one of Polymerase Chain Reaction (PCR), a microarray technique, and RNA-sequencing, data on the expression levels of at least three target genes of the at least one additional cellular signaling pathway derived from the sample, wherein the transcription factor element of the at least one additional cellular signaling pathway controls transcription of the at least three target genes of the at least one additional cellular signaling pathway,
2. calculating the activity level of the transcription factor element of the at least one additional cellular signaling pathway in the sample using a calibrated pathway model, wherein the calibrated pathway model compares the expression levels of the at least three target genes from the at least one additional cellular signaling pathway in the sample with expression levels of the at least three target genes from the at least one additional cellular signaling pathway in the calibrated pathway model which define an activity level of the transcription factor element of the at least one additional cellular signaling pathway; and,
ii. calculating the activity level of the at least one additional cellular signaling pathway in the sample based on the calculated activity level of the transcription factor element of the at least one additional cellular signaling pathway in the sample; and,
c. calculating a risk score using a calibrated Multi-Pathway Score (MPS) model, wherein the calibrated MPS model compares the calculated activity level of the TGF-β cellular signaling pathway and the calculated activity level of the at least one additional cellular signaling pathway in the sample with an activity level of a TGF-β cellular signaling pathway and activity level of the at least one additional cellular signaling pathway determinative of the occurrence of a clinical event, wherein the calculated activity of the TGF-β cellular signaling pathway is increased in the sample and the calculated activity of the at least one additional cellular signaling pathway is increased in the sample, and wherein the calibrated MPS model thus calculates a high risk score, and wherein calculating the risk score using the calibrated MPS model comprises the formula MPS=$w_t \cdot P_t + w_x \cdot P_x$, wherein $P_t$ is the calculated activity of the TGF-β cellular signaling pathway and $w_t$ is a weighting coefficient representing a correlation between the activity of the TGF-β cellular signaling pathway and the risk of the clinical event occurring; and wherein $P_x$ is the calculated activity of the at least one additional cellular signaling pathway, and $w_x$ is a weighting coefficient representing a correlation between the activity of the at least one additional cellular signaling pathway and the risk of the clinical event occurring;
d. assigning a high risk of experiencing the clinical event associated with a disease within a defined period of time based on the calculated high risk score, wherein the disease is breast cancer; and
e. prescribing a course of treatment to decrease the risk of the clinical event occurring based on the assigned high risk of experiencing the clinical event, wherein the course of treatment is configured to inhibit the TGF-β cellular signaling pathway and/or the at least one additional cellular signaling pathway; and
f administering the prescribed course of treatment to the subject to inhibit the TGF-β cellular signaling pathway and/or the at least one additional cellular signaling pathway;
wherein the clinical event is development of breast cancer, recurrence of breast cancer, or progression of breast cancer.

2. The method of claim 1, wherein calculating the risk score using the calibrated MPS model comprises the formula:

$$MPS = w_t \cdot P_t + w_p \cdot P_p + w_w \cdot P_w + w_e \cdot P_e + w_h \cdot P_h$$

wherein $P_t$, $P_p$, $P_w$, $P_e$, and $P_h$ denote the calculated activity of the TGF-β cellular signaling pathway, the PI3K cellular signaling pathway, the Wnt cellular signaling pathway, the ER cellular signaling pathway, and the HE cellular signaling pathway respectively; and
wherein $w_t$, $w_p$, $w_w$, $w_e$, and $w_h$ are, respectively, weighting coefficients representing a correlation between the activity of the TGF-β cellular signaling pathway and the risk of the clinical event occurring, the activity of the PI3K cellular signaling pathway and the risk of the clinical event occurring, the activity of the Wnt cellular signaling pathway and the risk of the clinical event occurring, the activity of the ER cellular signaling pathway and the risk of the clinical event occurring, and the activity of the cellular signaling pathway and the risk of the clinical event occurring.

3. A method of treating a subject suffering from a disease, wherein the disease places the subject at risk of experiencing a clinical event in a defined period of time, comprising:
a. receiving information regarding the risk that the subject will experience a clinical event within a defined period of time associated with the disease, wherein the disease is breast cancer, wherein the risk is determined by:
i. calculating an activity level of a transforming growth factor-β (TGF-β) cellular signaling pathway in a sample isolated from the subject, wherein the TGF-β cellular signaling pathway activity is calculated by:
1. Calculating an activity level of a TGF-β transcription factor element in the sample, wherein the TGF-β transcription factor element comprises a SMAD family member, and wherein the activity level of the TGF-β transcription factor element in the sample is calculated by:
a. obtaining, by using at least one of Polymerase Chain Reaction (PCR), a microarray technique, and RNA-sequencing, data on the expression levels of at least three TGF-β target genes derived from the sample, wherein the TGF-β transcription factor element controls transcription of the at least three TGF-β target genes, b. calculating the activity levels of the TGF-β transcription factor element in the sample using a calibrated pathway model, wherein the calibrated pathway model compares the expression levels of the at least three TGF-β target genes in the sample with expression levels of the at least three TGF-β target genes in the calibrated pathway model which define an activity level of the TGF-β transcription factor element; and, 2. calculating the activity level of the TGF-β cellular signaling pathway in the sample based on the calculated activity level of the TGF-β transcription factor element in the sample; and, ii. calculating an activity level of at least one additional cellular signaling pathway in the sample, wherein the at least one additional cellular signaling pathway is selected from a phosphatidylinositide 3-kinase (PI3K) signaling pathway, a Wnt signaling pathway, an estrogen-receptor (ER) signaling pathway, or a hedgehog (HH) signaling pathway in the sample, wherein the activity level of the at least one additional cellular signaling pathway is calculated by:

1. Calculating an activity level of a transcription factor element from the at least one additional cellular signaling pathway in the sample, wherein the PI3K signaling pathway transcription factor element comprises a FOXO family member, the Wnt signaling pathway transcription factor element comprises β-catenin/TCF4, the ER signaling pathway transcription factor element comprises an ERα dimer, and the HH signaling pathway transcription factor element comprises a GLI family member, and wherein the activity level of the transcription factor element of the at least one additional cellular signaling pathway is calculated by:

a. obtaining, by using at least one of Polymerase Chain Reaction (PCR), a microarray technique, and RNA-sequencing, data on the expression levels of at least three target genes of the at least one additional cellular signaling pathway derived from the sample, wherein the transcription factor element of the at least one additional cellular signaling pathway controls transcription of the at least three target genes of the at least one additional cellular signaling pathway, b. calculating the activity level of the transcription factor element of the at least one additional cellular signaling pathway in the sample using a calibrated pathway model, wherein the calibrated pathway model compares the expression levels of the at least three target genes from the at least one additional cellular signaling pathway in the sample with expression levels of the at least three target genes from the at least one additional cellular signaling pathway in the calibrated pathway model which define an activity level of the transcription factor element of the at least one additional cellular signaling pathway; and, 2. calculating the activity level of the at least one additional cellular signaling pathway in the sample based on the calculated activity level of the transcription factor element of the at least one additional cellular signaling pathway in the sample; and, iii. calculating a risk score using a calibrated Multi-Pathway Score (MPS) model, wherein the calibrated MPS model compares the calculated activity level of the TGF-β cellular signaling pathway and the calculated activity level of the at least one additional cellular signaling pathway in the sample with an activity level of a TGF-β cellular signaling pathway and activity level of the at least one additional cellular signaling pathway determinative of the occurrence of the clinical event, wherein the calculated activity of the TGF-β cellular signaling pathway is increased in the sample and the calculated activity of the at least one additional cellular signaling pathway is increased in the sample, and wherein the calibrated MPS model thus calculates a high risk score, and wherein calculating the risk score using the calibrated MPS model comprises the formula $MPS = w_t \cdot P_t + w_x \cdot P_x$, wherein $P_t$ is the calculated activity of the TGF-β cellular signaling pathway and $w_t$ is a weighting coefficient representing a correlation between the activity of the TGF-β cellular signaling pathway and the risk of the clinical event occurring; and wherein $P_x$ is the calculated activity of the at least one additional cellular signaling pathway, and $w_x$ is a weighting coefficient representing, a correlation between the activity of the at least one additional cellular signaling pathway and the risk of the clinical event occurring; and iv. assigning a high risk of experiencing the clinical event based on the calculated high risk score; and, b. prescribing a course of treatment to decrease the risk of the clinical event occurring based on the assigned high risk that the subject will experience the clinical event within the certain period of time, wherein the course of treatment is configured to inhibit the TGF-β cellular signaling pathway and/or the at least one additional cellular signaling pathway; and c. administering the prescribed course of treatment to the subject to inhibit the TGF-β cellular signaling pathway and/or the at least one additional cellular signaling pathway;

wherein the clinical event is development of breast cancer, recurrence of breast cancer, or progression of breast cancer.

4. The method of claim 3, wherein the risk monotonically increases with an increasing activity level of the TGF-β cellular signaling pathway in the sample.

5. The method of claim 4, wherein the course of treatment comprises a TGF-β cellular signaling pathway inhibitor.

6. The method of claim 3, wherein the at least one additional cellular signaling pathway is at least the PI3K cellular signaling pathway and wherein the risk monotonically increases with an increasing activity level of the PI3K cellular signaling pathway in the sample.

7. The method of claim 6, wherein the course of treatment comprises a PI3K cellular signaling pathway inhibitor.

8. The method of claim 3, wherein the expression levels of the TGF-β target genes ANGPTL4, CDC42EP3, D1, SERPINE1, JUNB, SKIL, or SMAD7 are determined.

* * * * *